US010344060B2

(12) United States Patent
Murray et al.

(10) Patent No.: US 10,344,060 B2
(45) Date of Patent: *Jul. 9, 2019

(54) POTENT AND SELECTIVE INHIBITORS OF NAV1.7

(71) Applicant: AMGEN INC., Thousand Oaks, CA (US)

(72) Inventors: Justin K. Murray, Moorpark, CA (US); Jerry Ryan Holder, Simi Valley, CA (US); Malgorzata Wanska, Oak Park, CA (US); Christopher M. Tegley, Thousand Oaks, CA (US); James R. Falsey, Moorpark, CA (US); Elizabeth M. Doherty, Thousand Oaks, CA (US); Leslie P. Miranda, Thousand Oaks, CA (US); Kaustav Biswas, Agoura Hills, CA (US); Bin Wu, Thousand Oaks, CA (US); Kelvin Sham, Thousand Oaks, CA (US); Jason C. Long, Newbury Park, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/773,756

(22) PCT Filed: Mar. 12, 2014

(86) PCT No.: PCT/US2014/025062

§ 371 (c)(1),
(2) Date: Sep. 8, 2015

(87) PCT Pub. No.: WO2014/165277

PCT Pub. Date: Oct. 9, 2014

(65) Prior Publication Data

US 2016/0024159 A1 Jan. 28, 2016

Related U.S. Application Data

(60) Provisional application No. 61/944,462, filed on Feb. 25, 2014, provisional application No. 61/778,331, filed on Mar. 12, 2013.

(51) Int. Cl.

| | |
|---|---|
| ***C07K 14/00*** | (2006.01) |
| ***C07K 14/435*** | (2006.01) |
| ***C07K 16/00*** | (2006.01) |
| ***C07K 19/00*** | (2006.01) |
| ***C07K 14/46*** | (2006.01) |
| ***C07K 14/47*** | (2006.01) |
| ***A61K 38/00*** | (2006.01) |
| ***A61K 38/16*** | (2006.01) |
| ***A61K 38/17*** | (2006.01) |
| ***A61K 47/64*** | (2017.01) |
| ***A61K 47/68*** | (2017.01) |

(52) U.S. Cl.

CPC .... *C07K 14/43518* (2013.01); *A61K 38/1767* (2013.01); *A61K 47/643* (2017.08); *A61K 47/6817* (2017.08); *A61K 38/00* (2013.01); *A61K 38/16* (2013.01); *A61K 38/1709* (2013.01); *C07K 14/435* (2013.01); *C07K 14/46* (2013.01); *C07K 14/47* (2013.01)

(58) Field of Classification Search

CPC ........ A61K 47/48438; A61K 47/48215; A61K 47/48284; A61K 38/00; A61K 47/48238; A61K 35/30; A61K 38/17; A61K 38/1709; A61K 8/64; C07K 14/00; C07K 2319/30; C07K 2319/31; C07K 2319/70; C07K 2319/00; C07K 2319/55; G01N 33/5058

See application file for complete search history.

(56) References Cited

U.S. PATENT DOCUMENTS

| | | | |
|---|---|---|---|
| 5,672,688 | A | 9/1997 | Kobayashi et al. |
| 5,756,663 | A | 5/1998 | Lampe et al. |
| 5,877,026 | A | 3/1999 | Lampe |
| 5,968,838 | A | 10/1999 | Lampe et al. |
| 6,670,329 | B2 | 12/2003 | Song-Ping |
| 7,125,676 | B2 | 10/2006 | George, Jr. et al. |

(Continued)

FOREIGN PATENT DOCUMENTS

| | | | | |
|---|---|---|---|---|
| CN | 1872878 | | * 12/2006 | |
| CN | 100429229 | | * 10/2008 | ........... C07K 14/435 |
| CN | 101428138 | | * 5/2009 | ............ A61K 38/17 |
| EP | 1 280 895 | B1 | 5/2001 | |
| JP | 2008000011 | A | 1/2008 | |
| WO | WO 95/01436 | A1 | 1/1995 | |
| WO | WO 95/11256 | A1 | 4/1995 | |
| WO | WO 00/15654 | A1 | 3/2000 | |
| WO | WO 01/54472 | A2 | 8/2001 | |
| WO | WO 02/083945 | A2 | 10/2002 | |
| WO | WO 03/101972 | A1 | 12/2003 | |

(Continued)

OTHER PUBLICATIONS

Burgess et al. J of Cell Bio. 1990, 111:2129-2138.*

(Continued)

*Primary Examiner* — Chang-Yu Wang
(74) *Attorney, Agent, or Firm* — Angela L. Purcell

(57) ABSTRACT

Disclosed is a composition of matter comprising an isolated polypeptide, which is a peripherally-restricted $Na_V1.7$ inhibitor. In some disclosed embodiments, the isolated polypeptide is an inhibitor of $Na_V1.7$. Other embodiments are conjugated embodiments of the inventive composition of matter and pharmaceutical compositions containing the inventive composition of matter. Isolated nucleic acids encoding some embodiments of inventive polypeptides and expression vectors, and recombinant host cells containing them are disclosed. A method of treating or preventing pain is also disclosed.

25 Claims, 194 Drawing Sheets

Specification includes a Sequence Listing.

(56) References Cited

U.S. PATENT DOCUMENTS

| | | | | |
|---|---|---|---|---|
| 7,125,847 | B1 | 10/2006 | Sachs et al. | |
| 7,132,505 | B1 | 11/2006 | Lazdunski et al. | |
| 7,259,145 | B2 | 8/2007 | Sachs et al. | |
| 7,375,234 | B2 | 5/2008 | Sharpless et al. | |
| 7,393,657 | B2 | 7/2008 | Diss et al. | |
| 7,396,816 | B2 | 7/2008 | Yokotagawa et al. | |
| 7,485,449 | B2 | 2/2009 | Rouleau et al. | |
| 7,528,093 | B2 | 5/2009 | Rouleau et al. | |
| 7,531,523 | B2 | 5/2009 | McCormack et al. | |
| 7,705,055 | B2 | 4/2010 | Ehring et al. | |
| 7,759,078 | B2 | 7/2010 | Djamgoz et al. | |
| 7,763,736 | B2 | 7/2010 | Sharpless et al. | |
| 7,767,718 | B2 | 8/2010 | Ehring et al. | |
| 7,972,813 | B2 | 7/2011 | McCormack et al. | |
| 8,372,396 | B2 | 2/2013 | Andya et al. | |
| 8,399,026 | B2 | 3/2013 | Meir et al. | |
| 9,279,003 | B2 * | 3/2016 | Park | C07K 14/43518 |
| 9,340,590 | B2 * | 5/2016 | Murray | C07K 14/43518 |
| 2004/0146877 | A1 | 7/2004 | Diss et al. | |
| 2004/0248207 | A1 | 12/2004 | Okuse et al. | |
| 2005/0137190 | A1 | 7/2005 | Gonzalez, III et al. | |
| 2005/0187217 | A1 | 8/2005 | Wilson et al. | |
| 2006/0025415 | A1 | 2/2006 | Gonzalez, III et al. | |
| 2006/0160817 | A1 | 7/2006 | Martinborough et al. | |
| 2009/0074665 | A1 | 3/2009 | Diss et al. | |
| 2010/0273866 | A1 | 10/2010 | Diss et al. | |
| 2011/0065647 | A1 | 3/2011 | Meir et al. | |
| 2011/0307966 | A1 | 12/2011 | MacDonald et al. | |
| 2011/0312533 | A1 | 12/2011 | Shekdar et al. | |
| 2013/0296247 | A1 * | 11/2013 | Park | C07K 14/43518 514/17.4 |
| 2015/0023988 | A1 * | 1/2015 | Murray | A61K 47/48369 424/179.1 |
| 2016/0222071 | A1 * | 8/2016 | Park | C07K 14/43518 |

FOREIGN PATENT DOCUMENTS

| | | | | |
|---|---|---|---|---|
| WO | WO 2004/099249 | A2 | 11/2004 | |
| WO | WO 2005/069969 | A2 | 8/2005 | |
| WO | WO 2005/118614 | A1 | 12/2005 | |
| WO | WO 2006/014493 | A2 | 2/2006 | |
| WO | WO 2007/023298 | A2 | 3/2007 | |
| WO | WO 2007/054785 | A1 | 5/2007 | |
| WO | WO 2007/109324 | A2 | 9/2007 | |
| WO | WO 2007/149542 | A2 | 12/2007 | |
| WO | WO 2009/033027 | A2 | 3/2009 | |
| WO | WO 2009/097530 | A2 | 8/2009 | |
| WO | WO 2010/104114 | A1 | 9/2010 | |
| WO | WO 2010/104115 | A1 | 9/2010 | |
| WO | WO2010/108153 | * | 9/2010 | A61K 39/395 |
| WO | WO 2010/108154 | A2 | 9/2010 | |
| WO | WO 2011/033358 | A2 | 3/2011 | |
| WO | WO 2011/051349 | A1 | 5/2011 | |
| WO | WO 2011/051350 | A1 | 5/2011 | |
| WO | WO 2011/051351 | A1 | 5/2011 | |
| WO | WO 2012/004664 | A2 | 1/2012 | |
| WO | WO 2012/075037 | A1 | 6/2012 | |
| WO | WO 2012/125973 | A2 | 9/2012 | |
| WO | WO 2013/158800 | A1 | 10/2013 | |
| WO | WO 2013/173706 | A2 | 11/2013 | |
| WO | WO 2014/110368 | A1 | 7/2014 | |

OTHER PUBLICATIONS

Bowie et al. Science, 1990, 247:1306-1310.*

Pawson et al. 2003, Science 300:445-452.*

Diochot et al. Bri. J. Pharmacol. 1999; 126:251-263.*

Chagot et al. Protein Sci. 2004; 13:1197-1208.*

Zeng et al.Toxicon, 2007; 49: 388-399.*

Zeng et al. Sheng Wu Gong Cheng Xue Bao. 2008; 24: 1228-32.*

Nicholson et al. Toxicon, 2004; 43:587-599.*

Lima et al. Comp. Biochem. & Physiol. 2007; 146: 264-279.*

Smith et al., J. Biol. Chem. 2007; 282: 12687-12697.*

Nicholson, 2007; 49: 490-512.*

Ahmad, et al. "A Stop Codon Mutation in SCN9A Causes Lack of Pain Sensation", *Human Molecular Genetics*; 16(17): 2114-2121 (2007).

Amaya, et al., The Voltage-Gated Sodium Channel $NA_v1.9$ Is an Effector of Peripheral Inflammatory Pain Hypersensitivity *J Neurosci* 26(50):12852-12860 (2006).

Black, et al., "Expression of Nav1.7 in DRG Neurons extends from Peripheral Terminals I the Skin to Central Preterminal Branches and Terminals in the Dorsal Horn"; *Molecular Pain*, 8:82, doi:01.1186/1744-8069-8-82 (2012).

Bolcskei, et al., "Voltage-Gated Sodium Channel Blockers, 2001-2006: An Overview"; *Medicinal Chemistry Research*; 17: 356-368 (2008).

Bosmans, et al., "Four Novel Tarantula Toxins as Selective Modulators of Voltage-Gated Sodium Channel Subtypes"; *Molecular Pharmacology*; 69: 419-429 (2006).

Bregman, et al., "Identification of a Potent, State-Dependent Inhibitor of Nav1.7 with Oral Efficacy in the Formalin Model of Persistent Pain"; *Journal of Medicinal Chemistry*; 54: 4427-4445 (2011).

Bulaj, et al., "Novel Conotoxins from *Conus striatus* and *Conus kinoshitai* Selectively Block TTX-Resistance sodum Channels"; *Biochemistry*; 44: 7259-7265 (2005).

Casula, et al., "Expression of the Sodium Channel β3 Subunit in Injured Human Sensory Neurons", *Neuro Report*; 15(10): 1629-1632 (2004).

Che, et al., "Soluble Expression and One-Step Purification of a Neurotoxin Huwentoxin-I in *Escherichia coli"; Protein Expression and Purification*; 65: 154-159 (2009).

Chen, et al., "Molecular diversity and evolution of cystine knot toxins of the tarantula Chilobrachys jingzhao," Cell Mol Life Sci 65(15):2531-2444 (2008).

Chen, et al., "Antinociceptive Effects of Intrathecally Administered Huwentoxin-I, a Selective N-Type Calcium Channel Blocker, in the Formalin Test in Conscious Rats"; *Toxicon*; 45: 15-20 (2005).

Chen, et al., "Syntheses, Folding and Bioactivity Analysis of K27A—HWTX-IV: A Mutant of the TTX—Sensitive Sodium Channel Inhibitor, Huwentoxin—IV"; *Journal of National Sciences, Hunan Norm University*; 26(3): 67-72 (2003) (Abstract Only in English).

Clare, Jeffrey J.; "Targeting voltage-Gated Sodium Channels for Pain Therapy"; *Expert Opinion on Investigational Drugs*; 19(1): 45-62 (2010).

Cox., et al, "An SCN9A Channelopathy Causes Congenital Inability to Experience Pain"; *Nature*; 444: 894-898 (2006).

Cummins, et al., "The Roles of Sodium Channels in Nociception: Implications for Mechanisms of Pain"; *Pain*; 131: 243-257 (2007).

Dancik, et al., "De Novo Peptide Sequencing via Tandem Mass Spectrometry", *Journal of Computational Biology*; 6(3/4): 327-342 (1999).

Dennis et al., "Albumin binding as a general strategy for improving the pharmacokinetics of proteins," *J Biol Chem*. 277(38): 35035-35043 (2002).

Dib-Hajj, et al., "Voltage-Gated Sodium Channnels in Pain States: Role in Pathophysiology and Target for Treatment"; *Brain Research Reviews*; t0; 65-83 (2009).

Diss, et al., "A Potential Novel Marker for Human Prostate Cancer: Voltage-Gated Sodium Channel Expression in vivo"; *Prostate Cancer and Prostatic Diseases*; 8: 266-273 (2005).

Dray, A., "Neuropathic Pain: Emerging Treatments"; *British Journal of Anaesthesia*;101(1); 48-58 (2008).

Edgerton, et al., "Evidence for Multiple Effects of ProTxII on Activation Gating in Nav1.5"; *Toxicon*; 52: 489-500 (2008).

Edgerton, et al., "Inhibition of the Activation Pathway of the T-Type Calcium Channel Cav3.1 by ProTxII"; *Toxicon*; 56: 624-636 (2010).

Ehrlich et al., "Preparation and characterization of albumin conjugates of a truncated peptide YY analogue for half-life extension," *Bioconjugate Chem* . 24:2015-2024 (2013).

Estacion, et al., "A Sodium Channel Mutation Linked to Epilepsy Increases Ramp and Persistent Current of Nav1.3 and Induces Hyperexcitability in Hippoampal neurons", *Experimental Neurology*; 224: 362-368 (2010).

(56) References Cited

OTHER PUBLICATIONS

Estacion, et al., "Nav1.7 Gain-of-Function Mutations as a Continuum: A1632E Displays Physioogical Changes Associated with Erythromelalgia and Paroxysmal Extreme Pain Disorder Mutations and Produces Symptom of Both Disorders"; *Journal of Neuroscience*; 28(43): 11079-11088 (2008).
Favreau, et al., "The Venom of the Snake Genus Atheris Contains a New Class of Peptides with Clusters of Histidine and Glycine Residues", *Rapid Communications of Mass Spectrometry*; 21: 406-412 (2007).
Fertleman, et al., "SCN9A Mutations in Paroxysmal Extreme Pain Disorder: Allelic Variants Underlie Distinict Channel Defects and Phenotypes", *Neuron*; 52, 767-774 (2006).
French, et al., "The Tetrodotoxin Receptor of Voltage-Gated Sodium Channels—Perspectives from Interactions with μ-Conotoxins"; *Marine Drugs*; 8: 2153-2161 (2010).
Gao, et al., "Expression of Voltage-Gated Sodium Channel a Subunit in Human Ovarian Cancer", *Oncology Reports*; 23: 1293-1299 (2010).
Gavva, et al., "Repeated Administration of Vanilloid Receptor TRPV1 Antagonists Attenuates Hyperthermis Elicited by TRPV1 Blockade"; *Journal of Pharmacology and Experimental Therapeutics*; 323: 128-137 (2007).
Ghelardini, et al., "Effects of a New Potent Analog of Tocainide on hNav1.7 Sodium Channels and In Vivo Neuropathic Pain Models"; *Neuroscience*; 169: 863-873 (2010).
Goldin, Alan L., "Resurgence of Sodium Channel Research"; *Annual Review Physiology*; 63:871-894 (2001).
Hackel, et al., "Transient Opening of the Perineurial Barrier for Analgesic Drug Delivery"; *Proceedings of the National Academy of Science* (*PNAS*); 109(29): E2018-2027 (2012).
Hains, et al., "Changes in Electrophysiological Properties and sodium Channel $Na_v1.3$ Expression in Thalamic Neurons After Spinal Cord Injury", *Brain*; 128: 2359-2371 (2005).
Han, et al., "Structurally Minimized μ-Conotoxin analogues as Sodium Channel Blockers: Implications for Designing Conopeptide-Based Therapeutics"; *ChemMedChem*; 4:406-414 (2009).
Han, et al., "Disulfide-Depleted Selenoconopeptides: a Minimalist Strategy to Oxidative Folding of Cysteine-Rich Peptides", *ACS Medicinal Chemical Letters*; 1(4): 140-144 (2010).
Harris, et al., "Effect of Pegylation on Pharmaceuticals", *Nature*; 2: 214-221 (2003).
Harty, et al., "Nav1.7 Mutant A863P in Erythromelalgia: Effects of Altered Activation and Steady-State Inactivation on Excitability of Nociceptive Dorsal Root GanglionNeurons"; *Journal of Neuroscience*; 26(48): 12566-12575 (2006).
Holland, et al., "Mutation of Sodium Channel SCN3A in a Patient with Cryptogenic Pediatric Partial Epilepsy", *NeuroScience Letters*; 433: 65-70 (2008).
Hoshiba, Junji, "Method for Hand-Feeding Mouse Pups with Nursing Bottles"; *Contemporary Topics*; 43(3): 50-53 (2004).
Hoyt, et al., "Discovery of a Novel Class of Benzazepinone Nav1.7 Blockers: Potential Treatments for Neuropathic Pain"; *Bioorganic & Medicinal Chemistry Letters*; 17: 4630-4634 (2007).
Hoyt, et al., "Benzazepinone Nav1.7 Blockers: Potential Treatments for Neuropathic Pain"; *Bioorganic & Medicinal Chemistry Letters*; 17: 6172-6177 (2007).
Jalali, et al., "OD1, the First Toxin Isolated from the Venom of the Scorpion *Odonthobuthus doriae* Active on Voltage-Gated Na+ Channels"; *FEBS Letters*; 579: 4181-4186 (2005).
Jarvis, et al., "A-803467, a Potent and Selective Nav1.8 Sodium channel blocker, Attenuates Neuropathic and Inflammatory Pain in the Rat"; *PNAS*; 104(20): 8520-8525 (2007).
Ji, et al., "Expression and Purification of Huwentoxin-I in Baculovirus system"; *Protein Expression & Purification*; 41: 454-458 (2005).
Jiang, et al., "Venom Gland Transcriptions of Two Elapid Snakes (*Bungarus multicinctus* and *Naja atra*) and Evolution of Toxin Genes", *BMC Genomics*; 12(1): downloaded from http://www.biomedcentral.com/1471-2164/12/1; (2011).
Jung et al., "Bypassing glycosylation: engineering aglycosylated full-length IgG antibodies for human therapy," *Curr Opin Biotechnol.* 22:858-867 (2011).
Kanai, et al., "Nav1.7 Sodium Channel-Induced $Ca^{2+}$ Influx Decreases Tau Phosphorylation via Glycogen Synthase Kinase-3β in Adrenal Chromaffin Cells"; *Neurochemistry International*; 54: 497-505 (2009).
Kay, et al., "Convergent Evolution with Combinatorial Peptides", *FEBS Letters*; 480: 55-62 (2000).
Kenyon et al., "$^{13}C$ NMR studies of the binding of medium-chain fatty acids to human serum albumin," *J Lipid Research* 35: 458-467 (1994).
Khoo, et al., "Structure of the Analgesic μ-Conotoxin KIIIA and Effects on the Structure and Function of Disulfide Deletion", *Biochemistry*; 48: 1210-1219 (2009).
Klein, et al., "Patterned Electrical Activity Modulates Sodium Channel Expression in Sensory Neurons", *Journal of Neuroscience Research*; 74: 192-198 (2003).
Klint, et al., "Spider-venom peptides that target voltage-gated sodium channels: pharmacological tools and potential therapeutic leads", *Toxicon*, 60(4):478-491 (2012).
Knudsen et al., "Potent derivatives of glucagon-like peptide-1 with pharmacokinetic properties suitable for once daily administration," *J Med Chem.* 43:1664-1669 (2000).
Krafte, et al., "Sodium Channels and Nociception: Recent Concepts and Therapeutic Opportunities", *Current Opinion in Pharmacology*; 8: 50-56 (2008).
Kratz, Felix, Albumin as a drug carrier: design of prodrugs, drug conjugates and nanoparticles, *J. Controlled Release* 132:171-183 (2008).
Kurtzhals et al., "Albumin binding of insulins acylated with fatty acids: characterization of the ligand-protein interaction and correlation between binding affinity and timing of the insulin effect in vivo," *Biochem J.* 312:725-731 (1995).
Li, et al., "Cloning and Functional Expresion of a Synthetic Gene Encoding Huwentoxin-I, a Neurotoxin From the Chinese Bird Spider (*Selenocosmia huwena*)"; *Toxicon*; 38: 153-162 (2000).
Liang, et al., "Properties and Amino Acid Sequence of Huwentoxin-I, A Neurotoxin Purified from the Venom of the Chinese Bird Spider *Selenocosmia huwena" Toxicon*; 31(8): 969-978 (1993).
Liang, et al., "Oxidative Folding of Reduced and Denatured Huwentoxin-I"; *Journal of Protein Chemistry*; 18(6): 619-625 (1999).
Liang, et al., "The Presynaptic Activity of Huwentoxin-I, a Neurotoxin from the Venom of the Chinese Bird Spider"; *Toxicon*; 38: 1237-1246 (2000).
Lindia, et al., "Relationship Between Sodium Channel $Na_v1.3$ Expression and Neuropathic Pain Behavior in Rats", *Pain*; 117: 145-153 (2005).
Liu, et al., "Assignment of the Disulfide Bonds of Huwentoxin-IV by Partial Reduction and Sequence Analysis"; *College of Life Sciences, Hunan Normal University*; 24(10): 1815-1819 (2003) (Abstract Only in English).
Maertens, et al., "Potent Modulation of the Voltage-Gated Sodium Channel Nav1.7 by OD1, a Toxin from the Scorpion *Odonthobuthus doriae"; Molecular Pharmacology*; 70(1): 405-414 (2006).
Mechaly, et al., "Molecular Diversity of Voltage-Gated Sodium Channel Alpha Subunits Expressed in Neuronal and Non-Neuronal Excitable Cells", *Neuroscience*; 130: 389-396 (2005).
Middleton, et al., "Two Tarantula Peptides Inhibit Activation of Multiple Sodium Channels"; *Biochemistry*; 41: 14734-14747 (2002).
Mogil, et al., "The Genetics of Pain and Pain Inhibition"; *PNAS*; 93: 3048-3055 (1996).
Mogil, et al., "Screening for Pain Phenotypes: Analysis of Three Congenic Mouse Strains on a Battery of Nine Nociceptive Assays"; *Pain*; 126: 24-34 (2006).
Nassar, et al., Nerve Injury Induces Robust Allodynia and Ectopic Discharges in $Na_v1.3$ Null Mutant Mice, *Molecular Pain* 2:33; doi: 10.1 186/1744-8069-2-33 (2006).
Nassar, et al., "Neuropathic Pain Develops Normally in Mice Lacking Both Nav1.7 and Nav1.8"; *Molecular Pain*; 1:24: doi: 10.1 186/1744-8069-1-24; (2005).
Nassar, et al., "Nociceptor-Specific Gene Deletion Reveals a Major Role for Nav1.7 (PN1) in Acute and Inflammatory Pain"; *PNAS*; 101(34): 12706-12711 (2004).

(56) References Cited

OTHER PUBLICATIONS

Noda, et al., "A Single Point Mutation Confers Tetrodotoxin and Saxitoxin Insensitivity on the Sodium Channel II"; *FEBS Letters*; 259(1): 213-216 (1989).
Norton, et al., "The Cystine Knot Structure of Ion Channel Toxins and Related Polypeptides"; *Toxicon*; 36: 1573-1583 (1998).
Norton, et al., "Potassium Channel Blockade by the Sea Anemone Toxin ShK for the Treatment of Multiple Sclerosis and Other Autoimmune Diseases", *Current Medicinal Chemistry*; 11: 2041-3052 (2004).
Oliveira, et al., "Binding Specificity of Sea Anemone Toxins to $Na_v$ 1.1-1.6 Sodium Channels", *Journal of Biological Chemistry*; 279(32): 33323-33335 (2004).
Ono, et al., "Characterization of Voltage-Dependent Calcium Channel Blocking Peptides from the Venom of the Tarantula *Grammostola rosea"; Toxicon*; 58: 265-276 (2011).
Park, et al., "Cysteine racemization during the Fmoc solid phase peptide synthesis of the Nav1.7-selective peptide—protoxin II", *Journal of Peptide Science*, 18(7):442-448 (2012).
Peng, et al., "The Effect of Huwentoxin-I on $CA_2$ Channels in differentiated NG108-15 Cells, a Patch-Clamp Study"; *Toxicon*: 39: 491-498 (2001).
Peng, et al., Additions and Corrections to "Function and Solution Structure of Huwentoxin-IV, a Potent Neuronal Tetrodotoxin (TTX)-Sensitive Sodium Channel Antagonist from Chinese Bird Spider *Seleno-Cosmia huwena"; Journal of Biological Chemistry* 278(7): 5489 (2003).
Priest, et al., "ProTx-I and ProTx-II: Gating Modifiers of Voltage-Gated Sodium Channels"; *Toxicon*; 49: 1940201 (2007).
Priest, Birgit T., "Future Potential and Status of Selective Sodium Channel Blockers for the Treatment of Pain", *Current Opinion in Drug Discovery & Development*; 12: 682-692 (2009).
Qu, et al., " Proton Nuclear Magnetic Resonance Studies on Huwentoxin-I from the Venom of the Spider *Selenocosmia huwena*: 1. Sequence-Specific $^{1}$H-NMR Assignments"; *Journal of Protein Chemistry*; 14(7): 549-557 (1995).
Qu, et al., "Proton Nuclear Magnetic Resonance Studies on Huwentoxin-I from the Venom of the Spider *Selenocosmia huwena*: 2. Three-Dimensional Structure in Solution"; *Journal of Protein Chemistry*; 16(6): 565-574 (1997).
Rogers, et al., "The Role of Sodium Channels in Neuropathic Pain", *Seminars in Cell & Development Biology*; 17: 571-581 (2006).
Schaller, et al., "Expression and Distribution of Voltage-gated Sodium Channels in the Cerebellum", *The Cerebellum*; 2: 2-9 (2003).
Schmalhofer, et al., "ProTx-11, a Selective Inhibitor of Nay1.7 Sodium Channels, Blocks Action Potential Propagation in Nociceptors"; *Molecular Pharmacology*; 74(5): 1476-1484 (2008).
Siang, et al., "Transcriptomic Analysis of the Venom Gland of the Red-Headed Krait (*Bungarus flaviceps*) using Expressed Sequence Tags", *BMC Molecular Biology*; 11:24; downloaded from http://www.biomedcentral.com/1471-2199/11/24 (2010).
Siqueira, et al., "Abnormal Expression of Voltage-Gated Sodium Channels Nav 1.7, Nav 1.3 and Nav1.8 in Trigeminal Neuralgia", Neuroscience; 164: 573-577 (2009).
Smith, et al., "Differential Phospholipid Binding by Site 3 and Site 4 Toxins: Implications for Structural Variability Between Voltage-Sensitive Sodium Channel Domains"; *Journal of Biological Chemistry*; 280: 11127-11133 (2005).
Smith, et al., Molecular Interactions of the Gating Modifier Toxin ProTx-II with Nav1.5: Implied Existence of a Novel Toxin Binding Site Coupled to Activation; *Journal of Biological Chemistry*; 282: 12687-12697 (2007).
Sokolov, et al., "Inhibition of Sodium Channel Gating by Trapping the Domain II Voltage Sensor with Protoxin II"; *Molecular Pharmacology*; 73(3): 1020-1028 (2008).
Steiner, et al., "Optimization of Oxidative Folding Methods for Cysteine-Rich Peptides: a Study of Conotoxins Containing Three Disulfide Bridges"; *Journal of Peptide Science*; 17: 1-7 (2011).
Stirling, et al., "Nociceptor-Specific Gene Deletion Using Heterozygous Nav1.8-Cre Recombinase Mice"; *Pain*; 113: 27-36 (2005).
Suchyna, et al., "Identification of a Peptide Toxin from Grammostola Spatulata spider Venom that Blocks Cation-Selective Stretch-Activated Channels", *Journal of General Physiology*; 115(5): 583-598 (2000).
Suchyna, et al., Correction "Identification of a Peptide Toxin from Grammostola Spatulata spider Venom that Blocks Cation-Selective Stretch-Activated Channels", *CORRECTION Journal of General Physiology*; p. 590, right column, lines 8-17 of paragraph 3, 115(5): 583-598 (2000).
Thimmapaya, et al., "Distribution and Functional Characterization of Human $Na_v$ 1.3 Splice Variants", *European Journal of Neuroscience*; 22: 1-9 (2005).
Uysal-Onganer, et al., "Epidermal Growth Factor Potentiates in vitro Metastatic Behaviour of Human Prostate Cancer PC-3M Cells: Involvement of Voltage-Gated Sodium Channel"; *Molecular Cancer*; 6:76; doi: 10.1 186/1476-4598-6-76; (2007).
Wang, et al., Modulatory Effect of Auxiliary $\beta_1$ Subumit on $Na_v$ 1.3 Voltage-Gated Sodium Channel Expressed in Xenopus Oocyte, *Chinese Medical Journal*; 120(8): 721-723 (2007).
Wang, et al., "The Cross Channel Activities of Spider Neurotoxin Huwentoxin-I on Rat Dorsal Root Ganglion Neurons"; *Biochemical and Biophysical Research Communications*; 357: 579-583 (2007).
Weiss, et al., "Loss-of-Function Mutations in Sodium Channel $Na_v$ 1.7 Cause Anosmia", *Nature*; doi: 10.1038/nature09975; (2011).
Wood, et al., "Voltage-Gated Sodium Channels and Pain Pathways", *Journal of Neurobiology*; 61: 55-71 (2004).
Xiao, et al., "Tarantula Huwentoxin-IV Inhibits Neuronal Sodium Channels by Binding to Receptor Site 4 and Trapping the Domain II Voltage Sensor in the Closed Configuration", *Journal of Biological Chemistry*; 283(40): 27300-27313 (2008).
Xiao, et al., "The Tarantula Toxins ProTx-II and HWTX-IV Differentially Interact with Human Hav 1.7 Voltage-Sensors to Inhibit Channel Activation and Inactivation", *Molecular Pharmacology Fast Forward*; doi: 10.1124/mol.110.066332; (2010).
Xiao, et al., "Synthesis andCharacterization of Huwentoxin-IV, a Neurotoxin Inhibiting Central Neuronal Sodium Channels"; *Toxicon*; 51: 230-239 (2008).
Yaksh, et al., "An Automated Flinch Detecting System for Use in the Formalin Nociceptive Bioassay"; *Journal of Applied Physiology*; 90: 2386-2402 (2001).
Yang, et al., "Mutations in SCN9A, Encoding a Sodium Channel Alpha Subunit, in Patients with Primary Erythermalgia"; *Journal of Medical Genetics*; 41: 171-174 (2004).
Yeomans, et al., "Decrease in Inflammatory Hyperalgesia by Herpes Vector-Mediated Knockdown of Nav1.7 Sodum Channels in Primary Afferents"; *Human Gene Therapy*; 16: 271-277 (2005).
Yuan, et al., "Effects and Mechanism of Chinese Tarantula Toxins on the Kv2.1 Potassium Channels"; *Biopchemical andBiophysical Research Communications*; 352: 799-804 (2007).
Zeng, et al., "Isolation and Characterization of Jingzhaotoxin-V, a Novel Neurotoxin from the venom of the Spider *Chilobrachys jingzhao"; Toxicon*; 49: 388-399 (2007).
Zeng et al. "Effects of Arg20 mutation on sodium channels activity of JZTX-V," *Chin. J. Biotech*. 24(7):1228-1232 (2008).
Zhang, et al., "Structure/Function Characterization of μ-Conotoxin KIIIA, an analgesic, nearly Irreversible Blocker of Mammalian Neuronal Sodium Channels", *Journal of Biological Chemistry*; 282(42): 30699-30706 (2007).
Zhang, et al., "μ-Conotoxin KIIIA Derivatives with Divergent Affinities Versus Efficacies in Blocking Voltage-Gated Sodium Channels", *Biochemistry*; 49: 4804-4812 (2010).
Zhang, et al., "Assignment of the Three Disulfide Bridges of Huwentoxin-I, a Neurotoxin from the Spider *Selenocosmia huwena*"; Journal of Protein Chemistry; 112(6): 735-740 (1993).
Zhang, et al., "Synergistic and Antagonistic Interactions Between Tetrodotoxin and μ-Conotoxin in Blocking Voltage-Gated Sodium Channels"; *Channels* (Austin); 3(1): 32-38 (2009).
Zhang, et al., "Cooccupancy of the Outer Vestibule of Voltage-Gated Sodium channels by μ-Conotoxin KIIIA and Saxitoxin or Tetrodotoxin"; *Journal Neurophysiology*; 104: 88-97 (2010).

(56) References Cited

OTHER PUBLICATIONS

Zhou, et al., Blockade of Neuromuscular Transmission by Huwentoxin-I, Purified From the Venom of the Chinese Bird Spider *Selenocosmia huwena; Toxicon*; 35(1): 39-45 (1997).
Zuliani, et al., "Recent Advances in the Medicinal Chemistry of Sodium Channel Blockers and their Therapeutic Potential"; *Current Topics in Medicinal Chemistry*; 9: 396-415 (2009).
International Search Report dated Jan. 9, 2015 for International Application No. PCT/US2014/025062.
International Preliminary Report on Patentability dated Aug. 14, 2015 for International Application No. PCT/US2014/025062.

* cited by examiner

From FIG. 76A n=2-26

Bis-{PEG23-ethyl}-5-((2-bromoacetamido)methyl)isophthalamide

To FIG. 79B $R_1$=H; SEQ ID NO:272

$R_1$ =
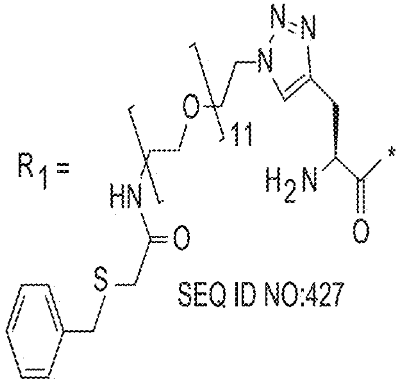
SEQ ID NO:427
$R_1$ =
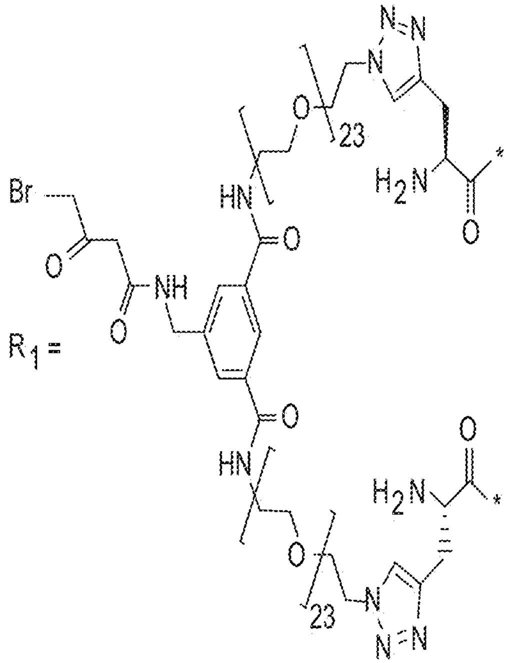
Homodimeric
Conjugate No. 1
$R_1$ =
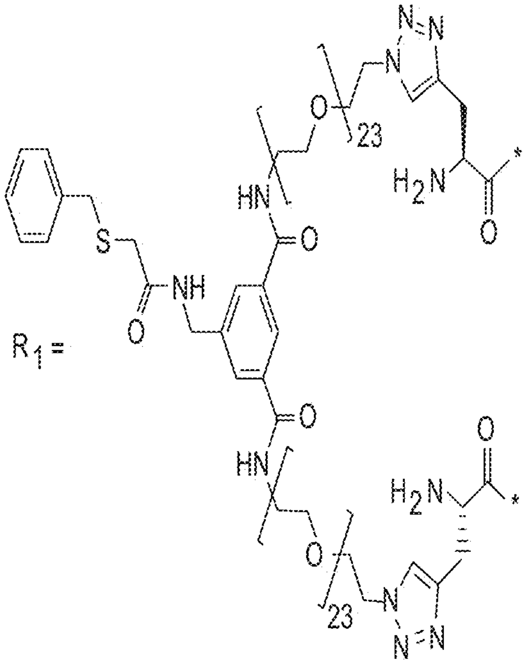
Homodimeric
Conjugate No. 2
*=[Nle6]JzTx-V(1-29) (SEQ ID NO: 272)
FIG. 81A-2

$R_1$ = aDNP E273C

If * =[Nle6]JzTx-V(1-29) (SEQ ID NO: 272), then Immunoglobulin Peptide Conjugate 1

Immunglobulin Peptide Conjugate 1 aDNP E273C

FIG. 83

Polypeptide , exemplified by:

-(GG)n-; -(GGG)n-

-(GS)n-;

-(SS)n-; -(SSS)n-

-(AA)n-; -(AA)n-

-(PP)n-; -(PPP)n-

-(hydroxyP)n- or any combination thereof

1. Poly-Glycine

2. Poly-Serine

3. Poly-Gly-Ser

4. Poly-Hydroxyproline

5. Rigid helical peptides

FIG. 85

KKYTYEINGKKITVEI

CHWEGNKLVC

```
|               |
S---------------S
```

n = 1-6
R = additional linker, or aliphatic, or polyether wtih
functional handle to attach to LM
Acid groups to attach to Nav1.7 directly or through linkers Alkyl/PEG based PEG based

POTENT AND SELECTIVE INHIBITORS OF NAV1.7

This application claims the benefit of U.S. Provisional Application No. 61/778,331, filed on Mar. 12, 2013, and U.S. Provisional Application No. 61/944,462, filed Feb. 25, 2014, which are both hereby incorporated by reference in their entireties.

The instant application contains a Sequence Listing which has been submitted electronically in ASCII format and is hereby incorporated by reference in its entirety. Said ASCII copy, created on Feb. 11, 2019, is named A 1779-WO-PCT_Suppl_SL-02072019.txt and is 1,291 kilobytes in size.

Throughout this application various publications are referenced within parentheses or brackets. The disclosures of these publications in their entireties are hereby incorporated by reference in this application in order to more fully describe the state of the art to which this invention pertains.

BACKGROUND OF THE INVENTION

Field of the Invention

The present invention relates to the biochemical arts, in particular to therapeutic peptides and conjugates.

Discussion of the Related Art

Voltage-gated sodium channels (VGSC) are glycoprotein complexes responsible for initiation and propagation of action potentials in excitable cells such as central and peripheral neurons, cardiac and skeletal muscle myocytes, and neuroendocrine cells. Mammalian sodium channels are heterotrimers, composed of a central, pore-forming alpha (α) subunit and auxiliary beta (β) subunits. Mutations in alpha subunit genes have been linked to paroxysmal disorders such as epilepsy, long QT syndrome, and hyperkalemic periodic paralysis in humans, and motor endplate disease and cerebellar ataxia in mice. (Isom, Sodium channel beta subunits: anything but auxiliary, Neuroscientist 7(1):42-54 (2001)). The β-subunit modulates the localization, expression and functional properties of α-subunits in VGSCs.

Voltage gated sodium channels comprise a family consisting of 9 different subtypes ($Na_V1.1$-$Na_V1.9$). As shown in Table 1, these subtypes show tissue specific localization and functional differences (See, Goldin, A. L., Resurgence of sodium channel research, Annu Rev Physiol 63: 871-94 (2001); Wilson et al., Compositions useful as inhibitors of voltage-gated ion channels, US 2005/0187217 A1). Three members of the gene family ($Na_V1.8$, 1.9, 1.5) are resistant to block by the well-known sodium channel blocker tetrodotoxin (TTX), demonstrating subtype specificity within this gene family. Mutational analysis has identified glutamate 387 as a critical residue for TTX binding (See, Noda, M., H. Suzuki, et al., A single point mutation confers tetrodotoxin and saxitoxin insensitivity on the sodium channel II" FEBS Lett 259(1): 213-6 (1989)).

TABLE 1

VGSC family with rat TTX $IC_{50}$ values.

| VGSC isoform | Tissue | TTX $IC_{50}$ (nM) | Indication |
|---|---|---|---|
| $Na_v1.1$ | CNS, PNS soma of neurons | 10 | Pain, Epilepsy, Neurodegeneration |
| $Na_v1.2$ | CNS high in axons | 10 | Neurodegeneration, Epilepsy |
| $Na_v1.3$ | CNS, embryonic, injured nerves | 2-15 | Pain, Epilepsy |
| $Na_v1.4$ | Skeletal muscle | 5 | Myotonia |
| $Na_v1.5$ | heart | 2000 | Arrhythmia, long QT |
| $Na_v1.6$ | CNS widespread, most abundant | 1 | Pain, movement disorders |
| $Na_v1.7$ | PNS, DRG, terminals neuroendocrine | 4 | Pain, Neuroendocrine disorders, prostate cancer |
| $Na_v1.8$ | PNS, small neurons in DRG & TG | >50,000 | Pain |
| $Na_v1.9$ | PNS, small neurons in DRG & TG | 1000 | Pain |

Abbreviations: CNS = central nervous system, PNS = peripheral nervous system, DRG = dorsal root ganglion, TG = Trigeminal ganglion. (See, Wilson et al., Compositions useful as inhibitors of Voltage-gated ion channels, US 2005/0187217 A1; Goldin, Resurgence of Sodium Channel Research, Annu Rev Physiol 63: 871-94 (2001)).

In general, voltage-gated sodium channels (Nays) are responsible for initiating the rapid upstroke of action potentials in excitable tissue in the nervous system, which transmit the electrical signals that compose and encode normal and aberrant pain sensations. Antagonists of $Na_V$ channels can attenuate these pain signals and are useful for treating a variety of pain conditions, including but not limited to acute, chronic, inflammatory, and neuropathic pain. Known $Na_V$ antagonists, such as TTX, lidocaine, bupivacaine, phenytoin, lamotrigine, and carbamazepine, have been shown to be useful for attenuating pain in humans and animal models. (See, Mao, J. and L. L. Chen, Systemic lidocaine for neuropathic pain relief, Pain 87(1): 7-17 (2000); Jensen, T. S., Anticonvulsants in neuropathic pain: rationale and clinical evidence, Eur J Pain 6 (Suppl A): 61-68 (2002); Rozen, T. D., Antiepileptic drugs in the management of cluster headache and trigeminal neuralgia, Headache 41 Suppl 1: S25-32 (2001); Backonja, M. M., Use of anticonvulsants for treatment of neuropathic pain, Neurology 59(5 Suppl 2): S14-7 (2002)).

The α-subunits of TTX-sensitive, voltage-gated $Na_V1.7$ channels are encoded by the SCN9A gene. The $Na_V1.7$ channels are preferentially expressed in peripheral sensory neurons of the dorsal root ganglia, some of which are involved in the perception of pain. In humans, mutations in the SCN9A gene have shown a critical role for this gene in pain pathways. For instance, a role for the $Na_V1.7$ channel in pain perception was established by recent clinical gene-linkage analyses that revealed gain-of-function mutations in the SCN9A gene as the etiological basis of inherited pain syndromes such as primary erythermalgia (PE), inherited erythromelalgia (IEM), and paroxysmal extreme pain disorder (PEPD). (See, e.g., Yang et al., Mutations in SCN9A, encoding a sodium channel alpha subunit, in patients with primary erythermalgia, J. Med. Genet. 41:171-174 (2004); Harty et al., $Na_V1.7$ mutant A863P in erythromelalgia: effects of altered activation and steady-state inactivation on excitability of nociceptive dorsal root ganglion neurons, J. Neurosci. 26(48):12566-75 (2006); Estacion et al., $Na_V1.7$ gain-of-function mutations as a continuum: A1632E displays physiological changes associated with erythromelalgia and paroxysmal extreme pain disorder mutations and produces symptoms of both disorders, J. Neurosci. 28(43): 11079-88 (2008)). In addition, overexpression of $Na_V1.7$ has been detected in strongly metastatic prostate cancer cell lines. (Diss et al., A potential novel marker for human prostate cancer: voltage-gated sodium channel expression in vivo, Prostate Cancer and Prostatic Diseases 8:266-73 (2005); Uysal-Onganer et al., Epidermal growth factor potentiates in vitro metastatic behavior human prostate cancer PC-3M cells: involvement of voltage-gated sodium channel, Molec. Cancer 6:76 (2007)).

Loss-of-function mutations of the SCN9A gene result in a complete inability of an otherwise healthy individual to sense any form of pain. (e g, Ahmad et al., A stop codon mutation in SCN9A causes lack of pain sensation, Hum. Mol. Genet. 16(17):2114-21 (2007)).

A cell-specific deletion of the SCN9A gene in conditional knockout mice reduces their ability to perceive mechanical, thermal or inflammatory pain. (Nassar et al., Nociceptor-specific gene deletion reveals a major role for $Na_V1.7$ (PN1) in acute and inflammatory pain, Proc. Natl. Acad. Sci, USA. 101(34): 12706-12711 (2004)).

Based on such evidence, decreasing $Na_V1.7$ channel activity or expression levels in peripheral sensory neurons of the dorsal root ganglia (DRG) has been proposed as an effective pain treatment, e.g. for chronic pain, neuropathic pain, and neuralgia. (E.g., Thakker et al., Suppression of SCN9A gene expression and/or function for the treatment of pain, WO 2009/033027 A2; Yeomans et al., Decrease in inflammatory hyperalgesia by herpes vector-mediated knockdown of $Na_V1.7$ sodium channels in primary afferents, Hum. Gene Ther. 16(2):271-7 (2005); Fraser et al., Potent and selective $Na_V1.7$ sodium channel blockers, WO 2007/109324 A2; Hoyt et al., Discovery of a novel class of benzazepinone Na(v)1.7 blockers: potential treatments for neuropathic pain, Bioorg. Med. Chem. Lett. 17(16):4630-34 (2007); Hoyt et al., Benzazepinone $Na_V1.7$ blockers: Potential treatments for neuropathic pain, Bioorg. Med. Chem. Lett. 17(22):6172-77 (2007)).

The α-subunits of TTX-sensitive, voltage-gated $Na_V1.3$ channels are encoded by the SCN3A gene. Four splice variants of human Nav1.3 were reported to have different biophysical properties. (Thimmapaya et al., Distribution and functional characterization of human $Na_V1.3$ splice variants, Eur. J. Neurosci. 22:1-9 (2005)). Expression of $Na_V1.3$ has been shown to be upregulated within DRG neurons following nerve injury and in thalamic neurons following spinal cord injury. (Hains et al., Changes in electrophysiological properties and sodium channel $Na_V1.3$ expression in thalamic neurons after spinal cord injury, Brain 128:2359-71 (2005)). A gain-in-function mutation in Nav1.3 (K354Q) was reportedly linked to epilepsy. (Estacion et al., A sodium channel mutation linked to epilepsy increases ramp and persistent current of $Na_V1.3$ and induces hyperexcitability in hippocampal neurons, Experimental Neurology 224(2):362-368 (2010)).

Toxin peptides produced by a variety of organisms have evolved to target ion channels. Snakes, scorpions, spiders, bees, snails and sea anemones are a few examples of organisms that produce venom that can serve as a rich source of small bioactive toxin peptides or "toxins" that potently and selectively target ion channels and receptors. In most cases, these toxin peptides have evolved as potent antagonists or inhibitors of ion channels, by binding to the channel pore and physically blocking the ion conduction pathway. In some other cases, as with some of the tarantula toxin peptides, the peptide is found to antagonize channel function by binding to a region outside the pore (e.g., the voltage sensor domain).

Native toxin peptides are usually between about 20 and about 80 amino acids in length, contain 2-5 disulfide linkages and form a very compact structure. Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency, stability, and selectivity. (See, e.g., Dauplais et al., On the convergent evolution of animal toxins: conservation of a diad of functional residues in potassium channel-blocking toxins with unrelated structures, J. Biol. Chem. 272(7):4302-09 (1997); Alessandri-Haber et al., Mapping the functional anatomy of BgK on Kv1.1, Kv1.2, and Kv1.3, J. Biol. Chem. 274(50):35653-61 (1999)). The majority of scorpion and *Conus* toxin peptides, for example, contain 10-40 amino acids and up to five disulfide bonds, forming extremely compact and constrained structures (microproteins) often resistant to proteolysis. The conotoxin and scorpion toxin peptides can be divided into a number of superfamilies based on their disulfide connections and peptide folds. The solution structure of many of these has been determined by Nuclear Magnetic Resonance (NMR) spectroscopy, illustrating their compact structure and verifying conservation of their family folding patterns. (E.g., Tudor et al., Ionisation behaviour and solution properties of the potassium-channel blocker ShK toxin, Eur. J. Biochem. 251(1-2):133-41(1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from *Orthochirus scrobiculosus* scorpion venom, Biochem. 36(6):1223-32 (1997); del Rio-Portillo et al.; NMR solution structure of Cn12, a novel peptide from the Mexican scorpion *Centruroides noxius* with a typical beta-toxin sequence but with alpha-like physiological activity, Eur. J. Biochem. 271(12): 2504-16 (2004); Prochnicka-Chalufour et al., Solution structure of discrepin, a new K+-channel blocking peptide from the alpha-KTx15 subfamily, Biochem. 45(6): 1795-1804 (2006)). Conserved disulfide structures can also reflect the individual pharmacological activity of the toxin family. (Nicke et al. (2004), Eur. J. Biochem. 271: 2305-19, Table 1; Adams (1999), Drug Develop. Res. 46: 219-34). For example, α-conotoxins have well-defined four cysteine/two disulfide loop structures (Loughnan, 2004) and inhibit nicotinic acetylcholine receptors. In contrast, ω-conotoxins have six cysteine/three disulfide loop consensus structures (Nielsen, 2000) and block calcium channels. Structural subsets of toxins have evolved to inhibit either voltage-gated or calcium-activated potassium channels.

Spider venoms contain many peptide toxins that target voltage-gated ion channels, including Kv, Cav, and Nay channels. A number of these peptides are gating modifiers that conform to the inhibitory cystine knot (ICK) structural motif. (See, Norton et al., The cystine knot structure of ion channel toxins and related polypeptides, Toxicon 36(11): 1573-1583 (1998); Pallaghy et al., A common structural motif incorporating a cystine knot and a triple-stranded β-sheet in toxic and inhibitory polypeptides, Prot. Sci. 3(10):1833-6, (1994)). In contrast to some scorpion and sea anemone toxins, many spider toxins do not affect the rate of inactivation but inhibit channel activity by restricting the movement of the voltage sensor into the open channel conformation, shifting their voltage dependence of activation to a more positive potential. Many of these spider toxins are promiscuous within and across voltage-gated ion channel families.

A variety of toxin peptides that target VGSCs, in particular, have been reported. (See, Billen et al., Animal peptides targeting voltage-activated sodium channels, Cur. Pharm. Des. 14:2492-2502, (2008)). Three classes of peptide toxins have been described: 1) site 1 toxins, the μ-conotoxins, bind to the pore of the channel and physically occlude the conduction pathway; 2) site 3 toxins, including the α-scorpion toxins, some sea anemone toxins and δ-conotoxins, bind to the S3-S4 linker of domain IV and slow channel inactivation; and 3) site 4 toxins, including the β-scorpion toxins, bind to the S3-S4 linker in domain II and facilitate channel activation. Both site 3 and site 4 families of peptides alter the open probability of $Na_V$ channels and affect gating transitions and are therefore called "gating modifiers."

μ-Conotoxin KIIIA (SEQ ID NO:530), a site 1 toxin originally isolated from *Conus kinoshitai*, is a C-terminally amidated peptide 16 amino acids in length that contains 6 cysteine residues engaged in 3 intramolecular disulfide bonds. It was initially characterized as an inhibitor of tetrodotoxin (TTX)-resistant sodium channels in amphibian dorsal root ganglion (DRG) neurons. (See, Bulaj et al., Novel conotoxins from *Conus striatus* and *Conus kinoshitai* selectively block TTX-resistant sodium channels, Biochem. 44(19):7259-7265, (2005)). Later it was found to more effectively inhibit TTX-sensitive than TTX-resistant sodium current in mouse DRG neurons. (See, Zhang et al., Structure/function characterization of μ-conotoxin KIIIA, an analgesic, nearly irreversible blocker of mammalian neuronal sodium channels, J. Biol. Chem. 282(42):30699-30706, (2007)) KIIIA has been found to block cloned mammalian (rodent) channels expressed in *Xenopus laevis* oocytes with the following rank order potency: $Na_V1.2>Na_V1.4>Na_V1.6>Na_V1.7>Na_V1.3>Na_V1.5$. Intraperitoneal injection of KIIIA has demonstrated analgesic activity in a formalin-induced pain assay in mice with an $ED_{50}$ of 1.6 nmol/mouse (0.1 mg/kg) without observed motor impairment; some motor impairment but not paralytic activity was observed at a higher dose (10 nmol). (See, Zhang et al., 2007). Substitution of alanine for Lys7 and Arg10 modified maximal block, while substitution of His12 and Arg14 altered Nav isoform specificity. (See, McArthur et al., Interactions of key charged residues contributing to selective block of neuronal sodium channels by μ-conotoxin KIIIA, Mol. Pharm. 80(4): 573-584, (2011)). "Alanine scan" analogs of KIIIA have identified Lys7, Trp8, Arg10, Asp11, His12, and Arg14 as being important for activity against $rNa_V1.4$. (See Zhang et al., 2007). The NMR solution structure of KIIIA places these residues within or adjacent to an α-helix near the C-terminus of the molecule. (See, Khoo et al., Structure of the analgesic μ-conotoxin KIIIA and effects on the structure and function of disulfide deletion, Biochem. 48(6):1210-1219, (2009)). The disulfide bond between Cys1 and Cys9 may be removed by substitution of alanine (KIIIA[C1A,C9A]) without greatly reducing the activity of the compound. (See, Khoo et al., 2009; Han et al., Structurally minimized μ-conotoxin analogs as sodium channel blockers: implications for designing conopeptide-based therapeutics, ChemMedChem 4(3):406-414, (2009)). Replacing a second disulfide bond between Cys2 and Cys16 with a diselenide bond between selenocysteine residues has given rise to the disulfide-depleted selenoconopeptide analogs of KIIIA These compounds have retained the activity of KIIIA but are more synthetically accessible. (See, Han et al., Disulfide-depleted selenoconopeptides: simplified oxidative folding of cysteine-rich peptides, ACS Med. Chem. Lett. 1(4):140-144, (2010)). The native structure has been further minimized to a lactam-stabilized helical peptide scaffold with Nay inhibitory activity. (See, Khoo et al., Lactam-stabilized helical analogues of the analgesic μ-conotoxin KIIIA, J. Med. Chem. 54:7558-7566 (2011)) KIIIA binds to the neurotoxin receptor site 1 in the outer vestibule of the conducting pore of the VGSCs and blocks the channel in an all-or-none manner. Recent studies have shown that some analogs of KIIIA only partially inhibit the sodium current and may be able to bind simultaneously with TTX and saxitoxin (STX). (See, Zhang et al., Cooccupancy of the outer vestibule of voltage-gated sodium channels by μ-conotoxin KIIIA and saxitoxin or tetrodotoxin, J. Neurophys. 104(1):88-97, (2010); French et al., The tetrodotoxin receptor of voltage-gated sodium channels—perspectives from interactions with μ-conotoxins, Marine Drugs 8:2153-2161, (2010); Zhang et al., μ-Conotoxin KIIIA derivatives with divergent affinities versus efficacies in blocking voltage-gated sodium channels. Biochem. 49(23):4804-4812, (2010); Zhang et al., Synergistic and antagonistic interactions between tetrodotoxin and μ-conotoxin in blocking voltage-gated sodium channels, Channels 3(1):32-38, (2009)).

OD1 (SEQ ID NO:589) is an α-like toxin isolated from the venom of the Iranian yellow scorpion *Odonthobuthus doriae*. (See, Jalali et al., OD1, the first toxin isolated from the venom of the scorpion *Odonthobuthus doriae* active on voltage-gated Na+ channels, FEBS Lett. 579(19):4181-4186, (2005)). This peptide is 65 amino acids in length with an amidated C-terminus containing 6 cysteine residues that form 3 disulfide bonds. OD 1 has been characterized as an $Na_V1.7$ modulator that impairs fast inactivation ($EC_{50}$=4.5 nM), increases the peak current at all voltages, and induces a persistent current, with selectivity against $Na_V1.8$ and $Na_V1.3$. (See Maertens et al., Potent modulation of the voltage-gated sodium channel Nav1.7 by OD1, a toxin from the scorpion *Odonthobuthus doriae*, Mol. Pharm. 70(1):405-414, (2006)).

Huwentoxin-IV(HWTX-IV; SEQ ID NO:528) is a 35 residue C-terminal peptide amide with 3 disulfide bridges between 6 cysteine residues isolated from the venom of the Chinese bird spider, *Selenocosmia huwena*. (See, Peng et al., Function and solution structure of huwentoxin-IV, a potent neuronal tetrodotoxin (TTX)-sensitive sodium channel antagonist from chinese bird spider *Selenocosmia huwena*, J. Biol. Chem. 277(49):47564-47571, (2002)). The disulfide bonding pattern (C1-C4, C2-5, C3-C6) and NMR solution structure place HWTX-IV in the ICK structural family since the C3-C6 disulfide bond passes through the 16-residue ring formed by the other two disulfide bridges (C1-C4 and C2-C5). HWTX-IV inhibits TTX-sensitive sodium currents in adult rat DRG neurons with an $IC_{50}$ value of 30 nM but has no effect on TTX-resistant VGSCs at up to a 100 nM concentration. (See, Peng et al., 2002). HWTX-IV was also 12-fold less potent against central neuronal sodium channels in rat hippocampus neurons, suggesting that it may be selective toward $Na_V1.7$. (See, Xiao et al., Synthesis and characterization of huwentoxin-IV, a neurotoxin inhibiting central neuronal sodium channels, Toxicon 51(2):230-239, (2008)). Testing HWTX-IV against VGSC sub-types determined the relative sensitivity to be hNav1.7 ($IC_{50}$=26 nM)>rNav1.2>>rNav1.3>rNav1.4>hNav1.5. (See Xiao et al., Tarantula huwentoxin-IV inhibits neuronal sodium channels by binding to receptor site 4 and trapping the domain II voltage sensor in the closed configuration, J. Biol. Chem. 283(40):27300-27313, (2008)). Site directed protein mutagenesis mapped the binding of HWTX-IV to neurotoxin site 4, the extracellular S3-S4 linker between domain II, and its behavior in response to changes in voltage and channel activation is consistent with binding to the voltage sensor of Nav1.7 and trapping it in the resting configuration. (See, Xiao et al., 2008). Huwentoxin-I (HWTX-I; SEQ ID NO:529), a related family member is less potent against VGSCs but is active against N-Type $Ca_V$ channels. (See, Wang et al., The cross channel activities of spider neurotoxin huwentoxin I on rat dorsal root ganglion neurons, Biochem. Biophys. Res. Comm. 357(3):579-583, (2007); Chen et al., Antinociceptive effects of intrathecally administered huwentoxin-I, a selective N-type calcium channel blocker, in the formalin test in conscious rats, Toxicon 45(1):15-20, (2005); Liang et al., Properties and amino acid sequence of huwentoxin-I, a neurotoxin purified from the venom of the Chinese bird spider *Selenocosmia huwena*, Toxicon 31(8):969-78, (1993)).

ProTx-II (SEQ ID NO:531), isolated from the venom of the tarantula *Thixopelma pruriens*, is a 30 amino acid polypeptide with a C-terminal free acid and 6 cysteine residues that form 3 disulfide bonds. It differs from other members of the ICK family because it contains only three residues between the fifth and sixth cysteine residues instead of the normal 4-11. ProTx-II is a potent inhibitor of several $Na_V$ channel sub-types including $Na_V1.2$, $Na_V1.7$ ($IC_{50}<1$ nM), $Na_V1.5$, and $Na_V1.8$, as well as Cav3.1 channels but not $K_V$ channels. (See, Middleton et al., Two tarantula peptides inhibit activation of multiple sodium channels, Biochem. 41(50):14734-14747, (2002); Priest et al., ProTx-I and ProTx-II: gating modifiers of voltage-gated sodium channels, Toxicon 49(2):194-201, (2007); Edgerton et al., Inhibition of the activation pathway of the T-type calcium channel CaV3.1 by ProTxII, Toxicon 56(4):624-636, (2010)). The "alanine scan" analogs of ProTx-II were tested against Nav1.5, identifying Meth, Trp7, Arg13, Met19, Val20, Arg22, Leu23, Trp24, Lys27, Leu29, and Trp30 as being important for activity. (See, Smith et al., Molecular interactions of the gating modifier toxin ProTx-II with Nav1.5: implied existence of a novel toxin binding site coupled to activation, J. Biol. Chem. 282(17):12687-12697, (2007)). Biophysical characterization showed that ProTx-II differs from HwTx-IV in its ability to interact with lipid membranes. (See, Smith et al., Differential phospholipid binding by site 3 and site 4 toxins: implications for structural variability between voltage-sensitive sodium channel comains, J. Biol. Chem. 280(12):11127-11133, (2005). Doses of 0.01 and 0.1 mg/kg i.v. of ProTx-II were well tolerated in rats, but 1 mg/kg doses were lethal. ProTx-II was not efficacious in a mechanical hyperalgesia study. (See, Schmalhofer et al., ProTx-II, a selective inhibitor of NaV1.7 sodium channels, blocks action potential propagation in nociceptors, Mol. Pharm. 74(5):1476-1484, (2008)). Intrathecal administration was lethal at 0.1 mg/kg and not effective in the hyperalgesia study at lower doses. ProTx-II application to desheathed cutaneous nerves completely blocked the C-fiber compound action potential but had little effect on action potential propagation of the intact nerve. (See, Schmalhofer et al., 2008). ProTx-II is believed to bind to the S3-S4 linker of domain II of $Na_V1.7$ to inhibit channel activation but may also interact with the domain IV voltage sensor and affect sodium channel activation at higher concentrations. (See, Xiao et al., The tarantula toxins ProTx-II and huwentoxin-IV differentially interact with human Nav1.7 voltage sensors to inhibit channel activation and inactivation, Mol. Pharm. 78(6):1124-1134, (2010); Sokolov et al., Inhibition of sodium channel gating by trapping the domain II voltage sensor with protoxin II, Mol. Pharm. 73(3):1020-1028, (2008); Edgerton et al., Evidence for multiple effects of ProTxII on activation gating in NaV1.5, Toxicon 52(3):489-500, (2008)).

Other peptide inhibitors of VGSCs isolated from spider venoms and peptide analogs were reported in Murray et al., Potent and selective inhibitors of Nav1.3 and Nav1.7, WO 2012/125973 A2; Meir et al., Novel peptides isolated from spider venom and uses thereof, US 2011/0065647 A1; Lampe et al., Analgesic peptides from venom of *Grammostola spatulata* and use thereof, U.S. Pat. No. 5,877,026; Park et al., Analogs of sodium channel peptide toxin, WO 2012/004664 A2; and Chen et al., Molecular diversity and evolution of cysteine knot toxins of the tarantula *Chilobrachys jingzhao*, cell. Mol. Life Sci. 65:2431-44 (2008).

Production of toxin peptides is a complex process in venomous organisms, and is an even more complex process synthetically. Due to their conserved disulfide structures and need for efficient oxidative refolding, toxin peptides present challenges to synthesis. (See, Steiner and Bulaj, Optimization of oxidative folding methods for cysteine-rich peptides: a study of conotoxins containing three disulfide bridges, J. Pept. Sci. 17(1): 1-7, (2011); Góngora-Benitez et al., Optimized Fmoc solid-phase synthesis of the cysteine-rich peptide Linaclotide, Biopolymers Pept. Sci. 96(1):69-80, (2011)). Although toxin peptides have been used for years as highly selective pharmacological inhibitors of ion channels, the high cost of synthesis and refolding of the toxin peptides and their short half-life in vivo have impeded the pursuit of these peptides as a therapeutic modality. Far more effort has been expended to identify small molecule inhibitors as therapeutic antagonists of ion channels, than has been given the toxin peptides themselves. One exception is the approval of the small ω-conotoxin MVIIA peptide (Prialt®, ziconotide), an inhibitor of neuron-specific N-type voltage-sensitive calcium channels, for treatment of intractable pain. The synthetic and refolding production process for ziconotide, however, is costly and only results in a small peptide product with a very short half-life in vivo (about 4 hours).

A small clinical trial in humans showed that local, non-systemic injection of the non-peptide tetrodotoxin produced pain relief in patients suffering from pain due to cancer and/or to chemotherapy (Hagen et al., J Pain Symp Manag 34:171-182 (2007)). Tetrodotoxin is a non-CNS-penetrant inhibitor of sodium channels including $Na_V1.3$ and $Na_V1.7$; although it cannot be used systemically due to lack of selectivity among sodium channel subtypes, its efficacy provides further validation for treating chronic pain syndromes with inhibitors of $Na_V1.7$ and/or $Na_V1.3$ in peripheral neurons.

Polypeptides typically exhibit the advantage of greater target selectivity than is characteristic of small molecules. Non-CNS penetrant toxin peptides and peptide analogs selective for Nav1.7 are desired, and are provided by the present invention.

SUMMARY OF THE INVENTION

The present invention is directed to a composition of matter comprising an isolated polypeptide, which is a peripherally-restricted $Na_V1.7$ inhibitor. In one embodiment, the isolated polypeptide is a selective inhibitor of $Na_V1.7$, a peptide analog of jingzhaotoxin-V ("JzTx-V"; YCQKWMWTCDSKRACCEGLRCKLWCRKII-$NH_2$//SEQ ID NO:2).

Some embodiments, the present invention are directed to a composition of matter comprising an isolated polypeptide comprising the amino acid sequence of the formula:

$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}Asp^{12}X_{aa}^{13}X_{aa}^{14}X_{aa}^{15}X_{aa}^{16}X_{aa}^{17}X_{aa}^{18}X_{aa}^{19}X_{aa}^{20}Leu^{21}X_{aa}^{22}X_{aa}^{23}X_{aa}^{24}X_{aa}^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}$// SEQ ID NO:590 or a pharmaceutically acceptable salt thereof, wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic or neutral hydrophilic amino acid residue;

$X_{aa}^{7}$ is a Trp, 5-bromoTrp, 6-bromoTrp, 5-chloroTrp, 6-chloroTrp, 1-Nal, 2-Nal, thioTrp, BhPhe, 2-BrhF, 2-ClhF, 2-FhF, 2-MehF, 2-MeOhF, 3-BrhF, 3-ClhF, 3-FhF, 3-MehF, 3-MeOhF, 4-BrhF, 4-ClhF, 4-FhF, 4-Me-F, 4-MehF, 4-MeOhF residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue;

$X_{aa}^{14}$ is a basic or acidic residue or an Ala residue;

$X_{aa}^{15}$ is an Arg or Cit residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly, Asp or Ala residue;

$X_{aa}^{22}$ is an acidic, basic, or neutral hydrophilic amino acid residue, or Ala or Val residue;

$X_{aa}^{23}$ is a Cys or SeCys residue;

$X_{aa}^{24}$ is a basic or neutral hydrophilic amino acid or Ala residue;

$X_{aa}^{25}$ is an aliphatic hydrophobic residue;

$X_{aa}^{26}$ is a Trp, 5-bromoTrp, 6-bromoTrp, 5-chloroTrp, 6-chloroTrp, 7-BrW, 1-Nal, 2-Nal, thioTrp, 5-phenylTrp, 5-iPrTrp, 5-ethylTrp, or 5-MeTrp residue;

$X_{aa}^{27}$ is a Cys or SeCys residue;

$X_{aa}^{28}$ is a basic or neutral hydrophilic amino acid residue;

$X_{aa}^{29}$ is a basic amino acid residue, or a Tyr or Leu residue;

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue, if $X_{aa}^{22}$ is an acidic amino acid residue; or $X_{aa}^{30}$ is an acidic amino acid residue or a Pro residue, if $X_{aa}^{22}$ is a basic or neutral hydrophilic amino acid residue or an Ala or Val residue;

$X_{aa}^{31}$ is an Ile, Trp, Phe, BhPhe, Cha, Tyr, 5-bromoTrp, 6-bromoTrp, 5-chloroTrp, 6-chloroTrp, 1-Nal, 2-Nal, thioTrp, or 4-tBu-F residue;

each of $X_{aa}^{32}$, $X_{aa}^{33}$, and $X_{aa}^{34}$ is independently absent or is independently a hydrophobic or acidic amino acid residue, or a Ser or Gly residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

Embodiments in which one or more of $X_{aa}^{14}$, $X_{aa}^{16}$, or $X_{aa}^{22}$ of SEQ ID NO:590 is an acidic amino acid residue are particularly useful.

In particular embodiments, the composition of matter comprises an amino acid sequence selected from SEQ ID NOS: 63, 69, 110-115, 131, 137, 139-147, 149-150, 152-154, 157, 159-172, 174-175, 177-179, 182, 184-246, 273-274, 277, 279, 284-295, 297-356, 392-397, 406-409, 411-422, 426, 435-437, 439-445, 447-452, 455-475, 518, 520, 521, 523, 524, 526, 527, 546-563, 565-566, 568, 573, 574, 576, 577, 578-588, SEQ ID NO:597, SEQ ID NO:605, SEQ ID NO:614, SEQ ID NO:615, SEQ ID NO:635, SEQ ID NO:636, SEQ ID NO:640, SEQ ID NO:641, SEQ ID NO:642, SEQ ID NO:643, SEQ ID NO:644, SEQ ID NO:645, SEQ ID NO:657, SEQ ID NO:667, SEQ ID NO:687, SEQ ID NO:688, SEQ ID NOS: 692-697, SEQ ID NO:701, SEQ ID NO:702, SEQ ID NO:707, SEQ ID NO:708, SEQ ID NO:709, SEQ ID NOS: 714-718, SEQ ID NO:721, SEQ ID NO:723, SEQ ID NOS: 726-729, SEQ ID NOS: 731-757, SEQ ID NOS: 764-785, SEQ ID NO:789, SEQ ID NO:790, SEQ ID NO:791, SEQ ID NOS: 795-801, SEQ ID NO:803, SEQ ID NO:804, SEQ ID NO:805, SEQ ID NO:807, SEQ ID NO:808, SEQ ID NO:809, SEQ ID NO:814, SEQ ID NOS: 816-824, SEQ ID NO:828, SEQ ID NO:829, SEQ ID NO:831, SEQ ID NO:833, SEQ ID NOS: 835-870, SEQ ID NOS: 873-885, SEQ ID NOS: 888-909, SEQ ID NO:911, SEQ ID NO:912, SEQ ID NO:913, SEQ ID NO:923, SEQ ID NO:924, SEQ ID NO:925, SEQ ID NO:929, SEQ ID NO:930, SEQ ID NO:931, SEQ ID NOS: 941-984, SEQ ID NOS: 986-1033, SEQ ID NOS: 1136-1188, SEQ ID NOS: 1190-1242, SEQ ID NO:1350, SEQ ID NO:1351, SEQ ID NO:1352, SEQ ID NO:1353, SEQ ID NOS: 1358-1369, SEQ ID NOS: 1382-1393, SEQ ID NOS: 1406-1417, SEQ ID NO:1430, SEQ ID NOS: 1432-1443, SEQ ID NOS: 1456-1467, SEQ ID NOS: 1480-1491, SEQ ID NOS: 1510-1515, SEQ ID NOS: 1522-1527, SEQ ID NOS: 1534-1611, SEQ ID NO: 1613, SEQ ID NOS: 1615-1640, SEQ ID NO:1644, SEQ ID NO:1645, and SEQ ID NOS: 1649-1694, as set forth in Table 5; or comprises an amino acid sequence selected from SEQ ID NOS: 63, 69, 112-113, 115, 131, 137, 193-196, 200-203, 207-210, 214-217, 221-224, 228-231, 235-238, 242-246, 277, and 279, as set forth in Table 5, that does not include a non-canonical amino acid.

Some embodiments comprise useful combinations of mutations to the native JzTx-V amino acid sequence, e.g, Glu residues at $Xaa^{14}$ and $Xaa^{30}$ of SEQ ID NO:590, such as SEQ ID NOS: 715, 728, 732, 735, 737, 742, 744, 746, 747, 748, 749, 753, 754, 755, 756, 757, 835, 836, 837, 953, 954, 955, 956, 957, 969, 970, 971, 972, 973, 974, 975, 976, 977, 978, 979, 980, 981, 982, 983, 984, 1002, 1003, 1004, 1005, 1006, 1018, 1019, 1020, 1021, 1022, 1023, 1024, 1025, 1026, 1027, 1028, 1029, 1030, 1031, 1032, 1137, 1157, 1158, 1159, 1160, 1161, 1173, 1174, 1175, 1176, 1177, 1178, 1179, 1180, 1181, 1182, 1183, 1184, 1185, 1186, 1187, 1188, 1191, 1211, 1212, 1213, 1214, 1225, 1227, 1228, 1229, 1230, 1231, 1232, 1233, 1234, 1235, 1236, 1237, 1238, 1239, 1240, 1241, 1242, 1351, 1353, 1360, 1362, 1363, 1366, 1368, 1369, 1384, 1386, 1387, 1390, 1392, 1393, 1408, 1410, 1411, 1414, 1416, 1417, 1434, 1436, 1437, 1440, 1442, 1443, 1458, 1460, 1461, 1464, 1466, 1467, 1482, 1484, 1485, 1488, 1490, 1491, 1628, 1629, 1673, 1674, 1677, 1678, 1683, 1686, or 1687, as set forth in Table 5.

Other examples include Glu residues at $Xaa^{16}$ and $Xaa^{30}$ of SEQ ID NO:590, such as SEQ ID NOS: 717, 733, 738, 740, 743, 745, 747, 749, 750, 751, 752, 753, 755, 756, 757, 770, 771, 773, 958, 959, 960, 961, 962, 963, 1138, 1162, 1163, 1164, 1165, 1166, 1167, 1192, 1361, 1367, 1385, 1391, 1409, 1415, 1430, 1435, 1441, 1459, 1465, 1483, 1489, 1596, 1597, 1598, 1600, 1602, 1645, or 1694, as set forth in Table 5.

Still other examples include Glu residues at $Xaa^{14}$ and $Xaa^{30}$ and a 5-BrTrp residue at $X_{aa}^{26}$ of SEQ ID NO:590, such as SEQ ID NOS: 1137, 1157, 1158, 1159, 1160, 1161, 1173, 1174, 1175, 1176, 1177, 1178, 1179, 1180, 1181, 1182, 1183, 1184, 1185, 1186, 1187, 1188, 1191, 1211, 1212, 1213, 1214, 1215, 1227, 1228, 1229, 1230, 1231, 1232, 1233, 1234, 1235, 1236, 1237, 1238, 1239, 1240, 1241, 1242, 1351, 1353, 1360, 1362, 1363, 1366, 1368, 1369, 1384, 1386, 1387, 1390, 1392, 1393, 1408, 1410, 1411, 1414, 1416, 1417, 1434, 1436, 1437, 1440, 1442, 1443, 1458, 1460, 1461, 1464, 1466, 1467, 1482, 1484, 1485, 1488, 1490, 1491, or 1629, as set forth in Table 5. Additional examples include Glu residues at $Xaa^{16}$ and $Xaa^{30}$ and a 5-BrTrp residue at $X_{aa}^{26}$ of SEQ ID NO:590, such as SEQ ID NOS: 1138, 1162, 1163, 1164, 1165, 1166, 1167, 1192, 1361, 1367, 1385, 1391, 1409, 1415, 1430, 1435, 1441, 1459, 1465, 1483, or 1489, as set forth in Table 5.

In some embodiments, the present invention is a subset of SEQ ID NO:590, directed to a composition of matter comprising an isolated polypeptide comprising the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}Asp^{12}X_{aa}^{13}X_{aa}^{14}Arg^{15}X_{aa}^{16}X_{aa}^{17}X_{aa}^{18}X_{aa}^{19}X_{aa}^{20}Leu^{21}X_{aa}^{22}X_{aa}^{23}X_{aa}^{24}Leu^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}//$$

SEQ ID NO:516 or a pharmaceutically acceptable salt thereof, wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic amino acid residue;

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue;

$X_{aa}^{14}$ is a basic residue or an Ala residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly or Ala residue;

$X_{aa}^{22}$ is an acidic, basic amino acid residue, or Ala residue;

$X_{aa}^{23}$ is a Cys or SeCys residue;

$X_{aa}^{24}$ is a basic amino acid or Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue;

$X_{aa}^{29}$ is a basic amino acid residue;

$X_{aa}^{30}$ is an Ile, Trp, Tyr, 5-bromoTrp, 6-bromoTrp, 5-chloroTrp, 6-chloroTrp, thioTrp, 1-Nal, or 2-Nal residue, if $X_{aa}^{22}$ is an acidic amino acid residue; or $X_{aa}^{30}$ is an acidic amino acid residue, if $X_{aa}^{22}$ is a basic amino acid residue or an Ala residue;

$X_{aa}^{31}$ is an Ile, Trp, Tyr, 5-bromoTrp, 6-bromoTrp, 5-chloroTrp, 6-chloroTrp, thioTrp, 1-Nal, or 2-Nal residue;

each of $X_{aa}^{32}$, $X_{aa}^{33}$, and $X_{aa}^{34}$ is independently absent or is independently a hydrophobic amino acid residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

In some of these embodiments, $X_{aa}^{22}$ is an acidic amino acid residue, such as a Glu, Asp, phosphoserine, phosphotyrosine, or gamma-carboxyglutamic acid residue.

In others of these embodiments, $X_{aa}^{22}$ is a basic amino acid residue (such as a histidine, lysine, homolysine, ornithine, arginine, N-methyl-arginine, ω-aminoarginine, ω-methyl-arginine, 1-methyl-histidine, 3-methyl-histidine, or homoarginine residue) or an Ala residue; and $X_{aa}^{30}$ is selected from Glu, Asp, phosphoserine, phosphotyrosine, and gamma-carboxyglutamic acid residues.

In particular embodiments, the composition of matter comprises an amino acid sequence selected from SEQ ID NOS: 63, 69, 110-115, 131, 137, 139-147, 149-150, 152-154, 157, 159-172, 174-175, 177-179, 182, 184-246, 273-274, 277, 279, 284-295, 297-356, 392-397, 406-409, 411-422, 426, 435-437, 439-445, 447-452, 455-475, 518, 520, 521, 523, 524, 526, 527, 546-563, 565-566, 568, 573, 574, 576, and 577, as set forth in Table 5; or comprises an amino acid sequence selected from SEQ ID NOS: 63, 69, 112-113, 115, 131, 137, 193-196, 200-203, 207-210, 214-217, 221-224, 228-231, 235-238, 242-246, 277, and 279, as set forth in Table 5, that does not include a non-canonical amino acid.

The present invention also encompasses a nucleic acid (e.g., DNA or RNA) encoding any of SEQ ID NOS: 63, 69, 112-113, 115, 131, 137, 193-196, 200-203, 207-210, 214-217, 221-224, 228-231, 235-238, 242-246, 277, or 279, as set forth in Table 5, that does not include a non-canonical amino acid; an expression vector comprising the nucleic acid; and a recombinant host cell comprising the expression vector.

In different embodiments, the present invention is directed to a subset of SEQ ID NO:590, in which the composition of matter comprises an isolated polypeptide comprising the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}$$
$$X_{aa}^{11}Asp^{12}X_{aa}^{13}X_{aa}^{14}Arg^{15}X_{aa}^{16}X_{aa}^{17}$$
$$X_{aa}^{18}X_{aa}^{19}X_{aa}^{20}Leu^{21}X_{aa}^{22}X_{aa}^{23}X_{aa}^{24}$$
$$Leu^{25}X_{aa}^{26}X_{aa}^{27}X_{aa}^{28}X_{aa}^{29}X_{aa}^{30}X_{aa}^{31}$$
$$X_{aa}^{32}X_{aa}^{33}X_{aa}^{34}//$$ SEQ ID NO:517 or a pharmaceutically acceptable salt thereof,
wherein:

$X_{aa}^{1}$ is absent; or $X_{aa}^{1}$ is any amino acid residue;

$X_{aa}^{2}$ is any hydrophobic amino acid residue, or a Pra, Aha, Abu, Nva, Nle, Sar, hLeu, hPhe, D-Leu, D-Phe, D-Ala, bAla, AllylG, CyA, or Atz residue;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic amino acid residue;

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Leu or Nle residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue;

$X_{aa}^{14}$ is a basic residue or an Ala residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly or Ala residue;

$X_{aa}^{22}$ is a basic amino acid residue, or Ala residue;

$X_{aa}^{23}$ is a Cys or SeCys residue;

$X_{aa}^{24}$ is a basic amino acid or Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue;

$X_{aa}^{29}$ is a basic amino acid residue;

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

$X_{aa}^{31}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

each of $X_{aa}^{32}$, $X_{aa}^{33}$, and $X_{aa}^{34}$ is independently absent or is independently a hydrophobic amino acid residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

In particular embodiments, the composition of matter comprises an amino acid sequence selected from SEQ ID NOS: 247, 296, 358, 360, 361, 363-370, 372-391, 398-405, 410, 423-425, 427, 431-434, 438, 446, 453, 454, 571, 579-587, and 588, as set forth in Table 5.

The compositions of the invention provide an effective method of treating, or preventing, pain, for example acute, persistent, or chronic pain. Selectivity against off-target sodium channels, particularly those governing cardiac excitability (Nav1.5) and skeletal muscle excitability ($Na_V$1.4), is cardinal for any systemically delivered therapeutic. This selectivity is a particularly high hurdle for a dual inhibitor. Compositions of the present invention provide such selectivity against Nav1.5 and Nav 1.4.

Consequently, the present invention is also directed to a pharmaceutical composition or a medicament containing the inventive composition of matter, and a pharmaceutically acceptable carrier.

The JzTx-V peptide analogs of the present invention are also useful as research tools, e.g., as probes for correctly folded, functional Nav1.7 in the plasma membrane of live cells. As and its congeners inhibit Nav1.7 they clearly bind to the channel molecule with high potency and selectivity. Labeling with fluorescent or other tracer groups at the non-active sites of the JzTx-V peptide analogs as defined by NMR (see, e.g., Example 6 herein) and by residue substitution can provide research tools suitable for, but not limited to, localizing sodium channels, sorting cells that express sodium channels, and screening or panning for peptides that bind to Nav1.7.

BRIEF DESCRIPTION OF THE DRAWINGS

FIG. 81A-2, left), Homodimeric Conjugate No. 1 (FIG. 81A-2, middle), and Homodimeric Conjugate No. 2 (FIG. 81A-2, right), and schematic structures of Immunoglobulin Peptide Conjugate 1 (FIGS. 81B-C). Within the scope of the invention, any other JzTx-V peptide analog sequence disclosed herein can be used in a conjugate instead of the illustrated SEQ ID NO:272.

FIG. 83 shows examples of peptidyl linkers. (See, also, Chen, X. et al. Adv. Drug Deliv. Rev. 2012 doi: 10.1016/j.addr.2012.09.039.)

FIG. 85 shows a schematic representation of peptide sequences/structures of beta-hairpin linkers KKYTYEING-KKITVEI//(SEQ ID NO:1745) and CHWEGNKLVC//(SEQ ID NO:1746).

FIG. 92A shows the cation exchange chromatogram of UV absorbance at 280 nm of the conjugation reaction using a 5-mL HiTrap SP-HP column. FIG. 92B shows a reducing SDS-PAGE gel of the peaks from the cation exchange chromatogram. Peak 1 shows the heavy chain (HC) and light chain (LC) of the non-reacted antibody. Peak 3 shows approximately 50% of the HC shifted (HC*) indicating a monovalent antibody-JzTx-V peptide dimer conjugate. Peak 4 shows nearly 100% HC shifted indicating bivalent antibody—JzTx-V peptide dimer conjugate (Immunoglobulin Peptide Conjugate 1).

FIG. 94A represents a monovalent heterodimeric Fc-toxin peptide analog fusion or conjugate with the toxin peptide analog fused or conjugated to the C-terminal end of one of the immunoglobulin Fc domain monomers. FIG. 94N represents a monovalent antibody with a toxin peptide analog moiety inserted into an internal loop of the immunoglobulin Fc domain of one of the HC monomers. Dimers or trimers will form spontaneously in certain host cells upon expression of a deoxyribonucleic acid (DNA) construct encoding a single chain. In other host cells, the cells can be placed in conditions favoring formation of dimers/trimers or the dimers/trimers can be formed in vitro. If more than one HC monomer, LC monomer, or immunoglobulin Fc domain monomer is part of a single embodiment, the individual monomers can be, if desired, identical or different from each other.

Figure 120:
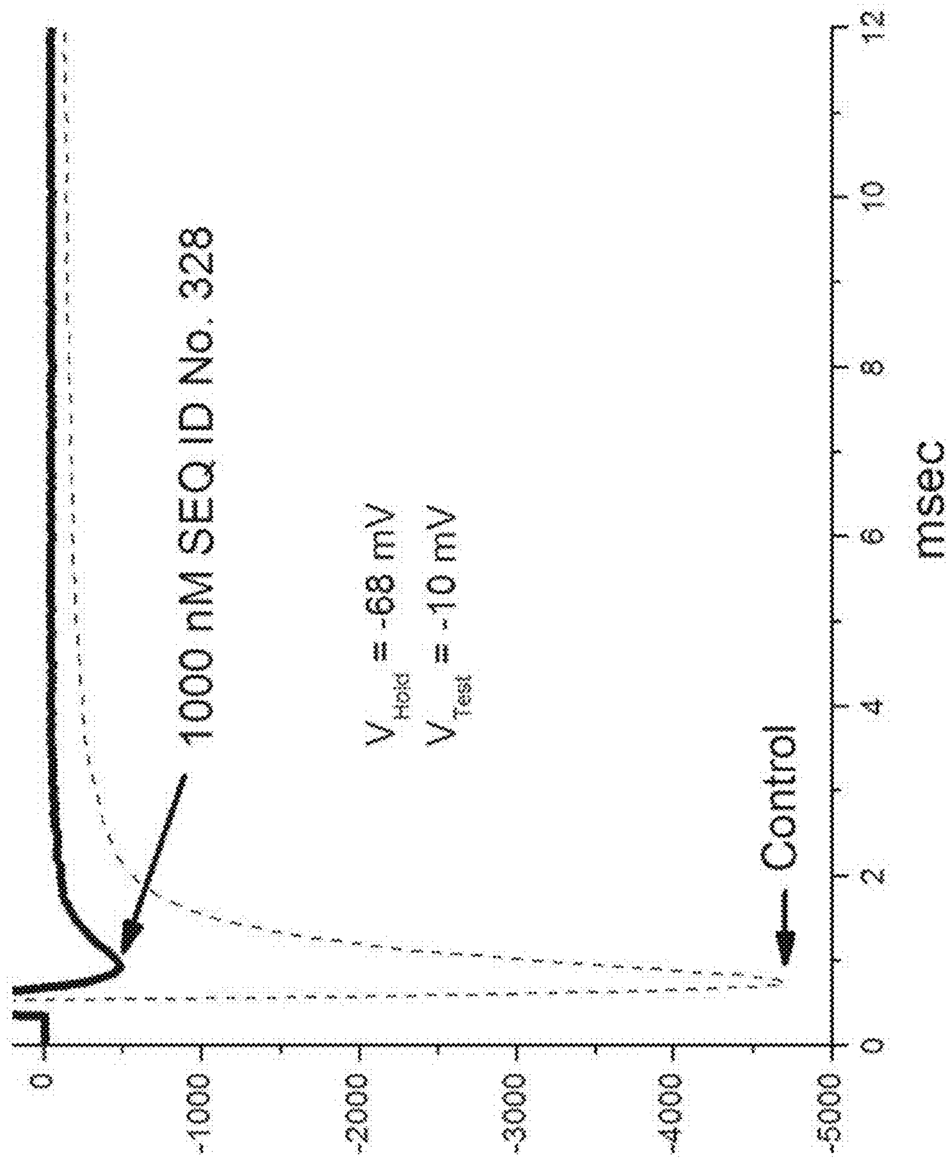

FIG. 120 shows the effect of Pra-[Nle6; Glu28]JzTx-V (1-29) (Seq ID No. 328) on human Nav1.3 Na channels expressed in CHO cells. Cell was held at −68 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM Pra-[Nle6; Glu28] JzTx-V(1-29) (Seq ID No. 328) blocks approximately 90% of Nav current.

Figure 121:
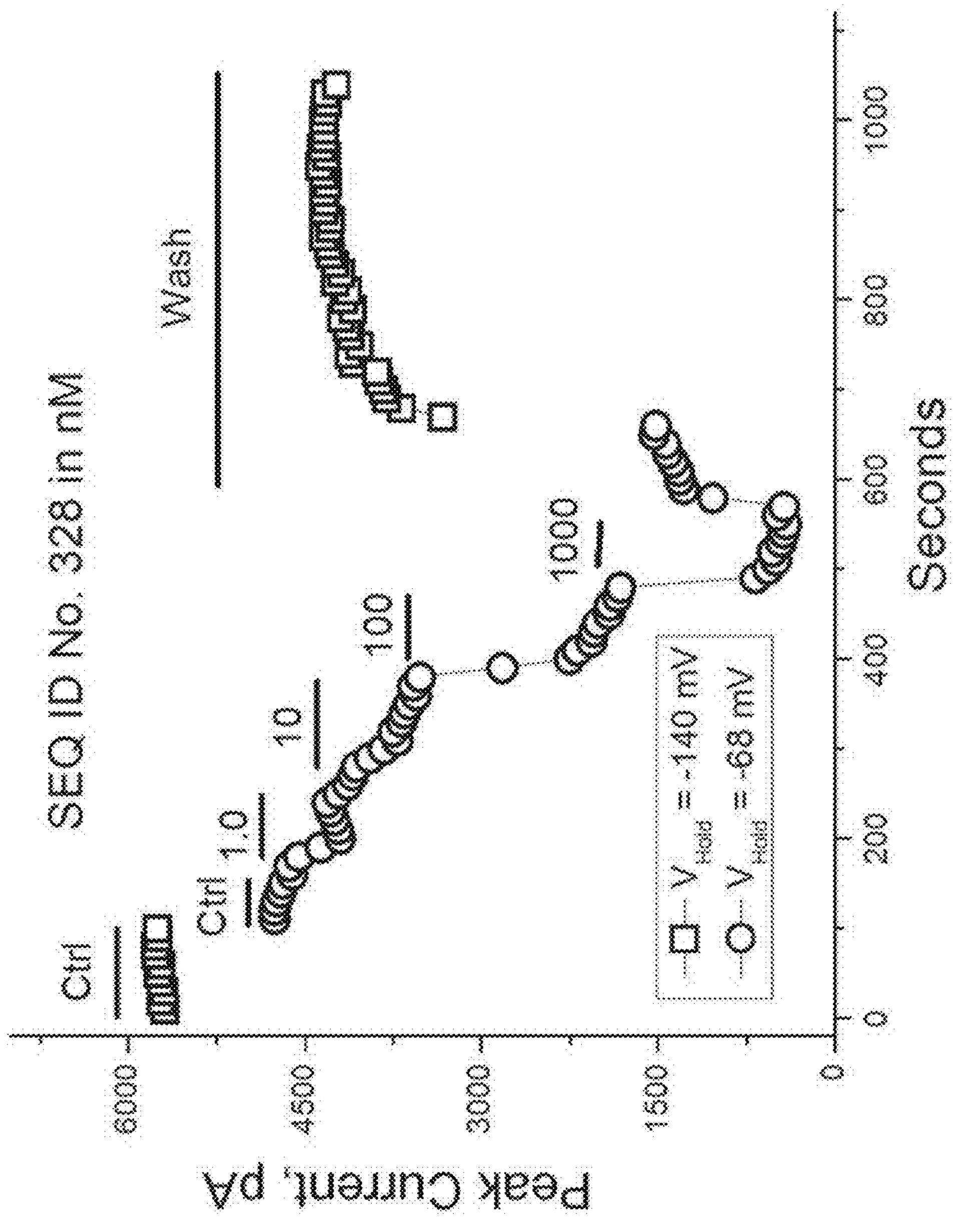

FIG. 121 shows the time course of increasing concentrations of Pra-[Nle6; Glu28]JzTx-V(1-29) (Seq ID No. 328) against human Nav1.3 Na channels expressed in CHO cells. Peak inward Nav currents were measured at −10 mV every 10 seconds in the presence of increasing concentrations of Pra-[Nle6; Glu28]JzTx-V(1-29) (Seq ID No. 328); cell was held at either −140 mV (squares), a voltage where Nav channels are completely non-inactivated, or −68 mV (circles), a voltage that yields approximately 20% inactivation. 'Ctrl' indicates Nav current in the absence of Seq ID No. 328 and 'Wash' indicates Nav current following removal of Seq ID No. 328.

Figure 122:
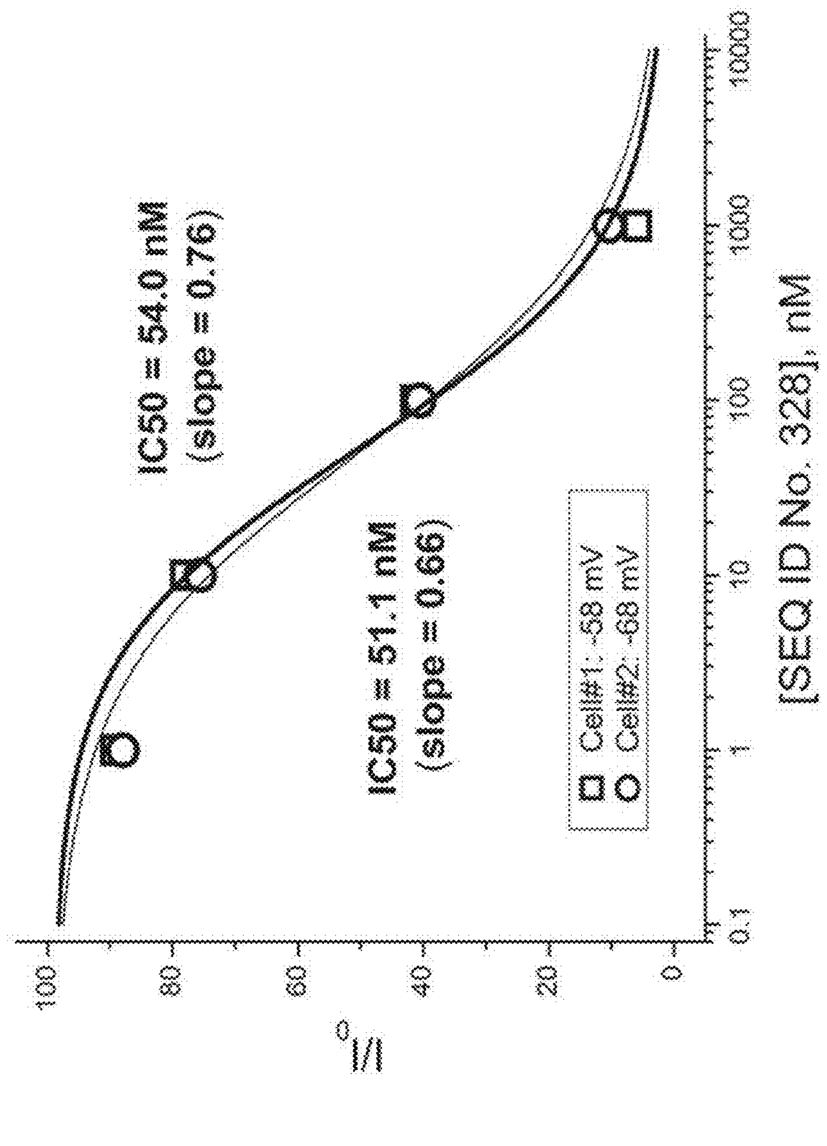

FIG. 122 shows the dose-response curves of Pra-[Nle6; Glu28]JzTx-V(1-29) (Seq ID No. 328) against human Nav1.3 Na channels in two separate CHO cells. Peak inward Nav currents were measured at −10 mV in the presence of increasing concentrations of Pra-[Nle6; Glu28]JzTx-V(1-29) (Seq ID No. 328) and divided by current before Seq ID No. 328 addition ($I/I_0$); cells were held at a voltage that yielded approximately 20% inactivation.

Figure 123:
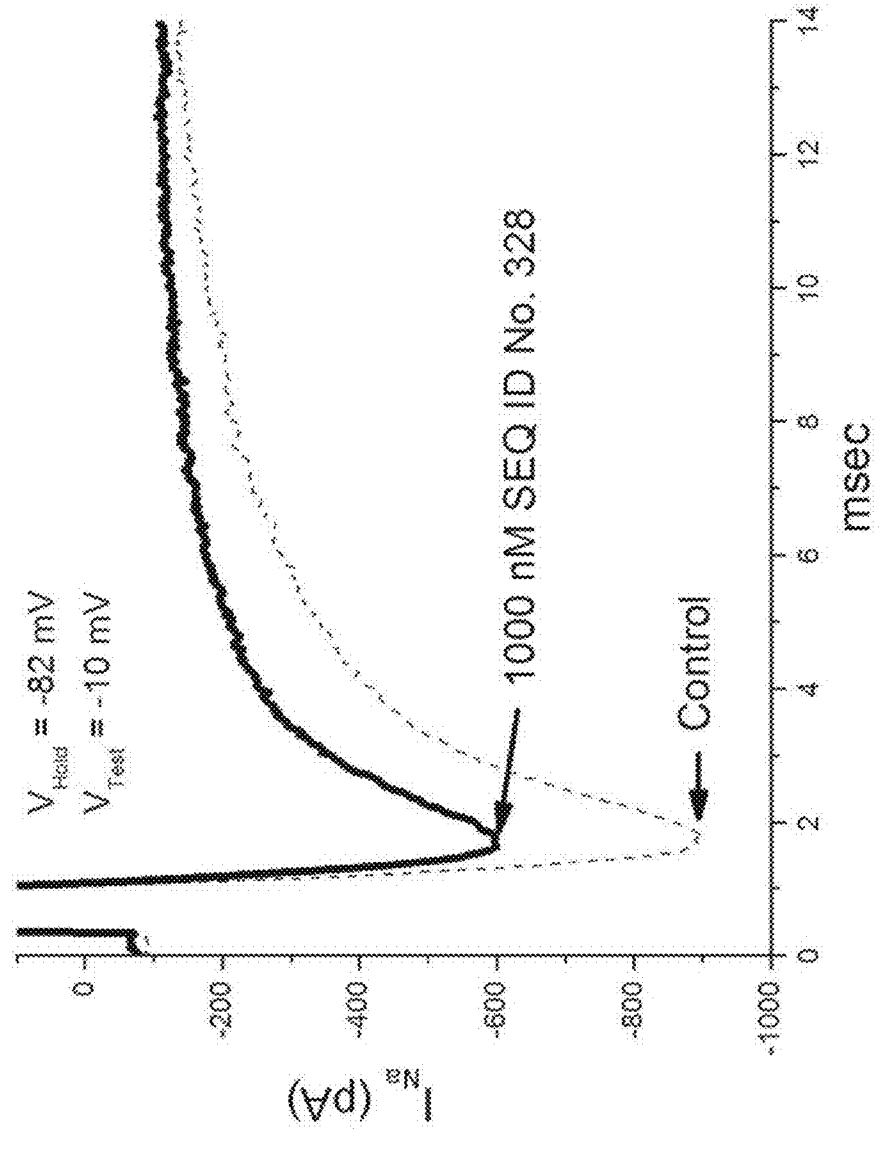

FIG. 123 shows the effect of Pra-[Nle6; Glu28]JzTx-V (1-29) (Seq ID No. 328) on hNav1.8 channels in CHO cell. Cell was held at −82 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM Seq ID No. 328 blocked approximately 30% of TTX-resistant hNav1.8 current. All solutions contained 0.5 μM TTX to block endogenous TTX-sensitive Nav currents.

Figure 124:
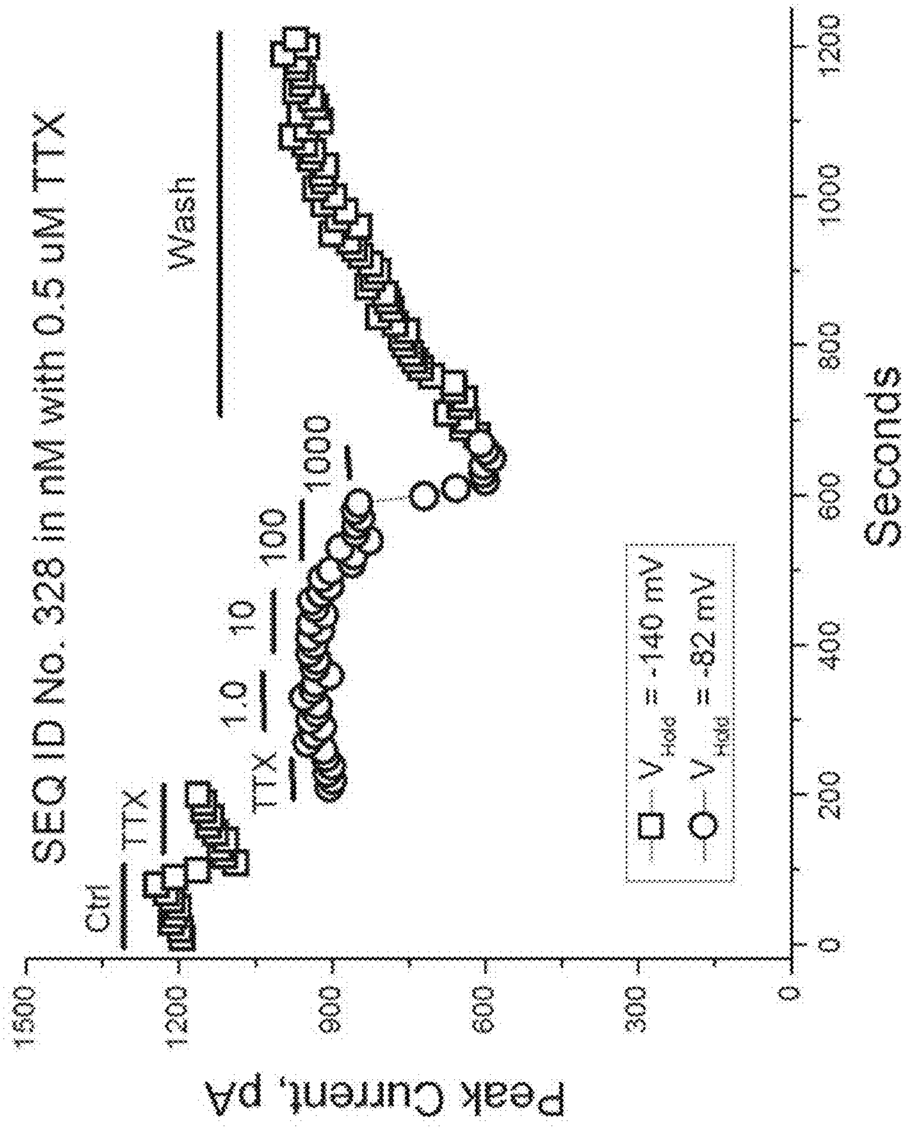

FIG. 124 shows the time course of increasing concentrations of Pra-[Nle6; Glu28]JzTx-V(1-29) (Seq ID No. 328) against hNav1.8 channels in CHO cell. Peak inward Nav currents were measured at −10 mV every 10 seconds in the presence of increasing concentrations of Seq ID No. 328; cell was held at either −140 mV (squares) or −82 mV (circles). 'TTX' indicates Nav current in the absence of Pra-[Nle6; Glu28]JzTx-V(1-29) (Seq ID No. 328) to block endogenous TTX-sensitive channels, and 'Wash' indicates Nav current following removal of Seq ID No. 328 and TTX. 0.5 μM TTX was present in all solutions when cells were held at −82 mV.

Figure 125:
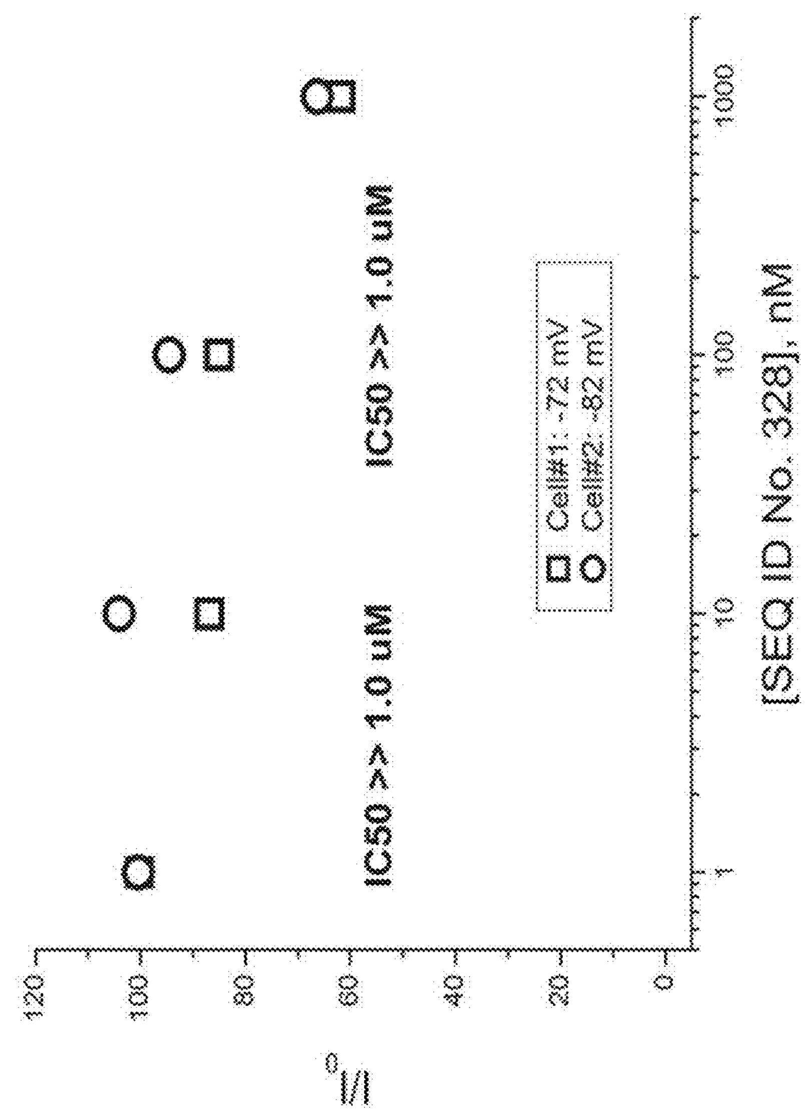

FIG. 125 shows the dose-response curves of Pra-[Nle6; Glu28]JzTx-V(1-29) (Seq ID No. 328) against hNav1.8 channels in two separate CHO cells. Peak inward Nav currents were measured at −10 mV in the presence of increasing concentrations of Seq ID No. 328 and divided by current before Pra-[Nle6; Glu28]JzTx-V(1-29) (Seq ID No. 328) addition ($I/I_0$); cells were held at a voltage that yielded approximately 20% inactivation.

Figure 126:
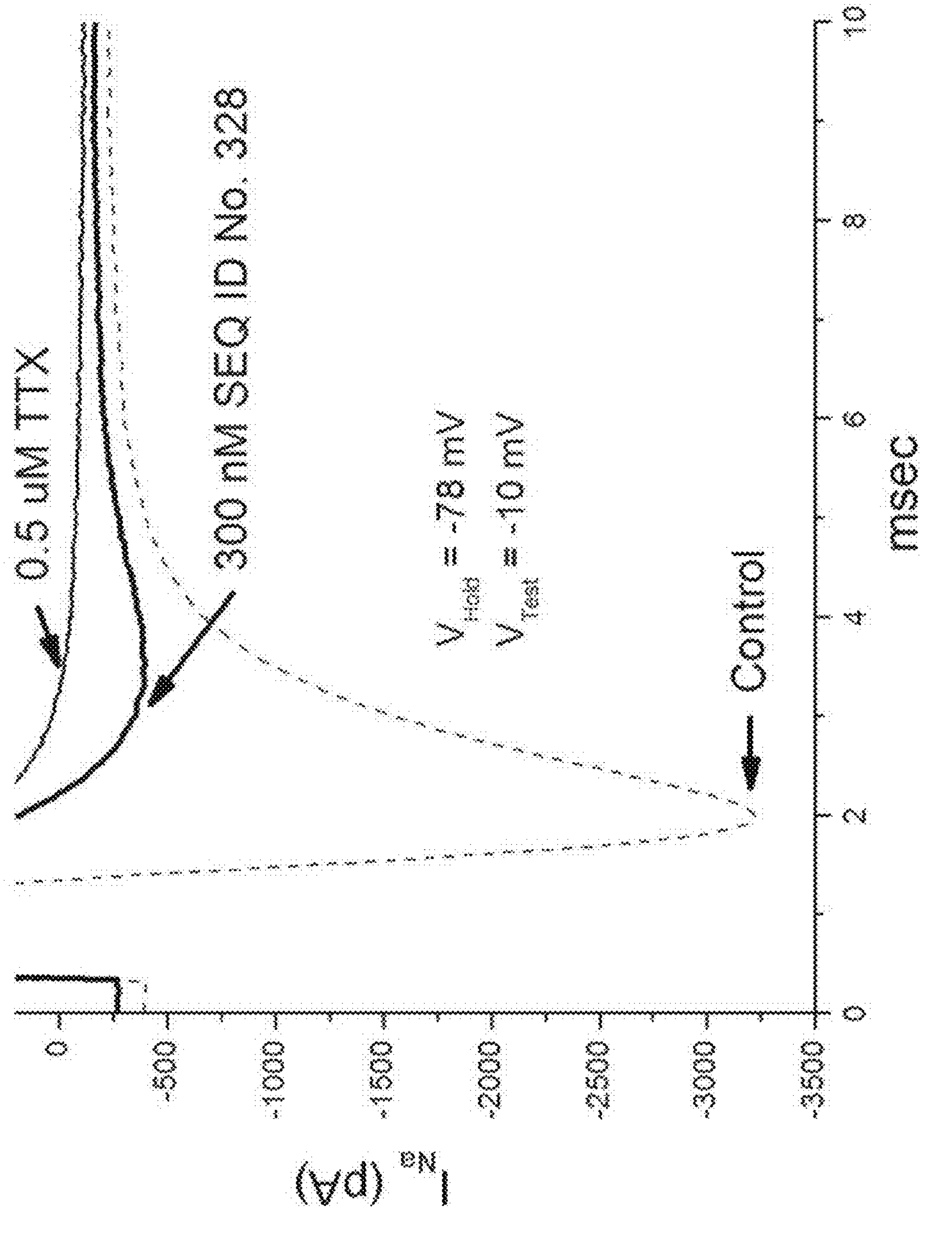

FIG. 126 shows the effect of Pra-[Nle6; Glu28]JzTx-V (1-29) (Seq ID No. 328) on TTX-sensitive Nay channels in Sprague Dawley rat DRG neuron. Cell was held at −78 mV and peak inward Nay currents were measured at −10 mV. 'Control' trace shows Nay current before Seq ID No. 328, '300 nM Seq ID No. 328' trace shows Nay current after Pra-[Nle6; Glu28]JzTx-V(1-29) (Seq ID No. 328) addition, and '0.5 μM TTX' trace shows Nay current after TTX. Note that 300 nM Seq ID No. 328 blocks approximately 85% of TTX-sensitive Nay current.

Figure 127:
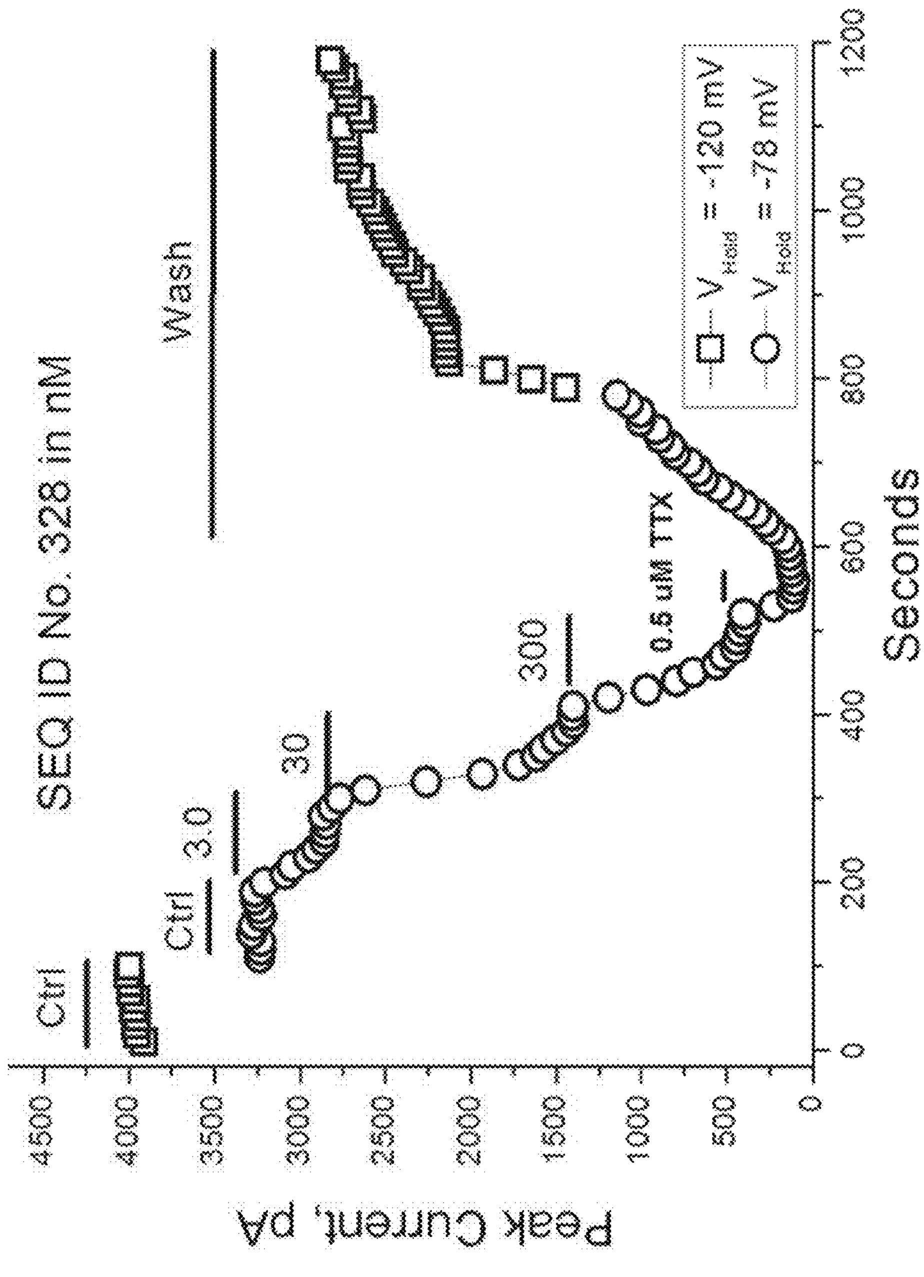

FIG. 127 shows the time course of increasing concentrations of Pra-[Nle6; Glu28]JzTx-V(1-29) (Seq ID No. 328) against TTX-sensitive Nay channels in Sprague Dawley rat DRG neuron. Peak inward Nay currents were measured at −10 mV every 10 seconds in the presence of increasing concentrations of Seq ID No. 328; cell was held at either −120 mV (squares), a voltage where Nay channels are completely non-inactivated, or −78 mV (circles), a voltage that yields approximately 20% inactivation. 'Ctrl' indicates Nay current in the absence of Pra-[Nle6; Glu28]JzTx-V(1-29) (Seq ID No. 328), '0.5 μM TTX' indicates Nay current in the presence of 0.5 μM TTX, and 'Wash' indicates Nay current following removal of Pra-[Nle6; Glu28]JzTx-V(1-29) (Seq ID No. 328) and TTX.

Figure 128:
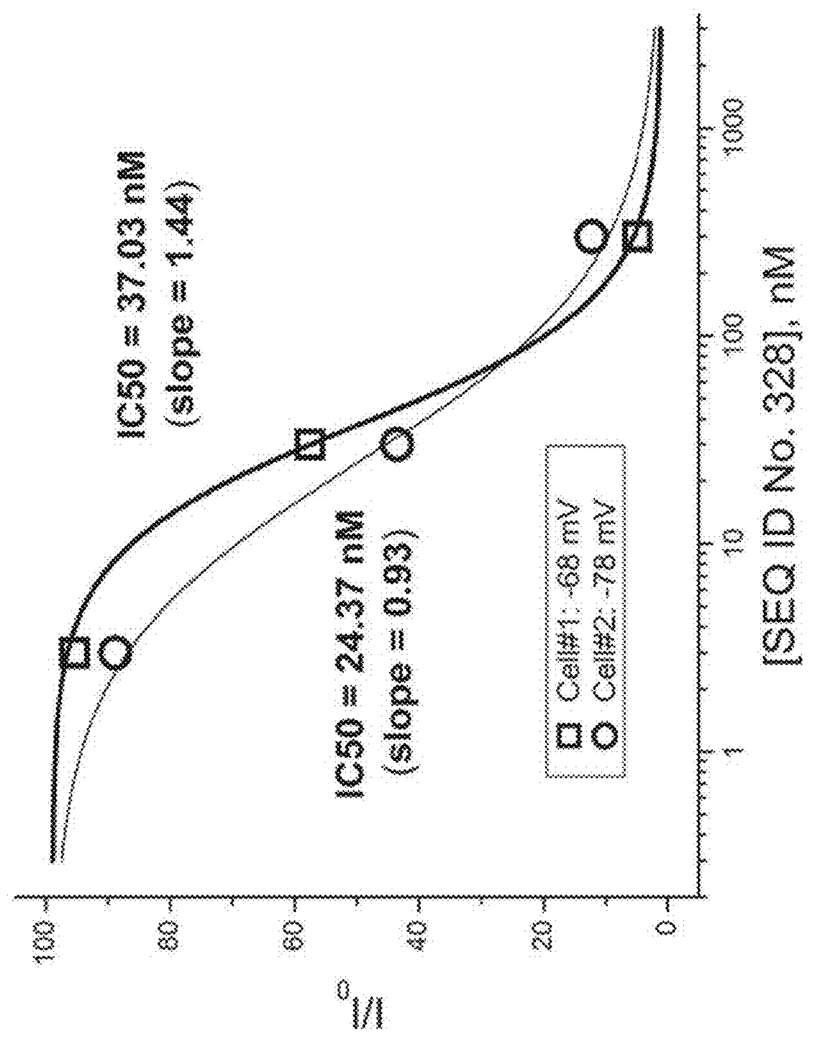

FIG. 128 shows the dose-response curves of Pra-[Nle6; Glu28]JzTx-V(1-29) (Seq ID No. 328) against TTX-sensitive Nay channels in two separate Sprague Dawley rat DRG neurons. Peak inward Nay currents were measured at −10 mV in the presence of increasing concentrations of Seq ID No. 328 and divided by current before Pra-[Nle6; Glu28] JzTx-V(1-29) (Seq ID No. 328) addition ($I/I_0$); cells were held at a voltage that yielded approximately 20% inactivation.

Figure 129:
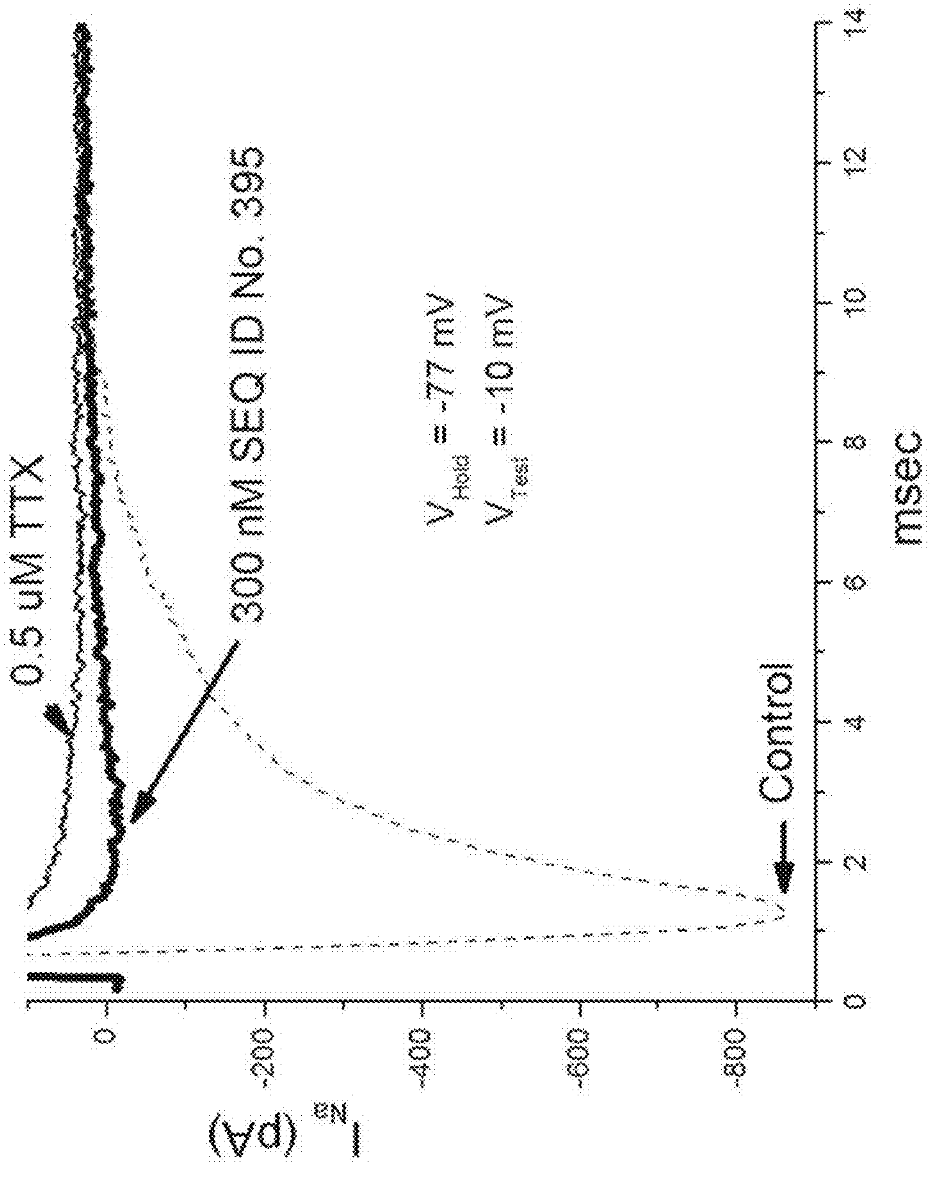

FIG. 129 shows the effect of CyA-[Nle6,Pra17,Glu28] JzTx-V(1-29) (Seq ID No. 395) on TTX-sensitive Nay channels in C57 Black 6 mouse DRG neuron. Cell was held at −77 mV and peak inward Nay currents were measured at −10 mV. 'Control' trace shows Nay current before Seq ID No. 395, '300 nM Seq ID No. 395' trace shows Nay current after Seq ID No. 395 addition, and '0.5 μM TTX' trace shows Nay current after TTX. Note that 300 nM CyA-[Nle6, Pra17,Glu28]JzTx-V(1-29) (Seq ID No. 395) blocks the majority of TTX-sensitive Nay current.

Figure 130:
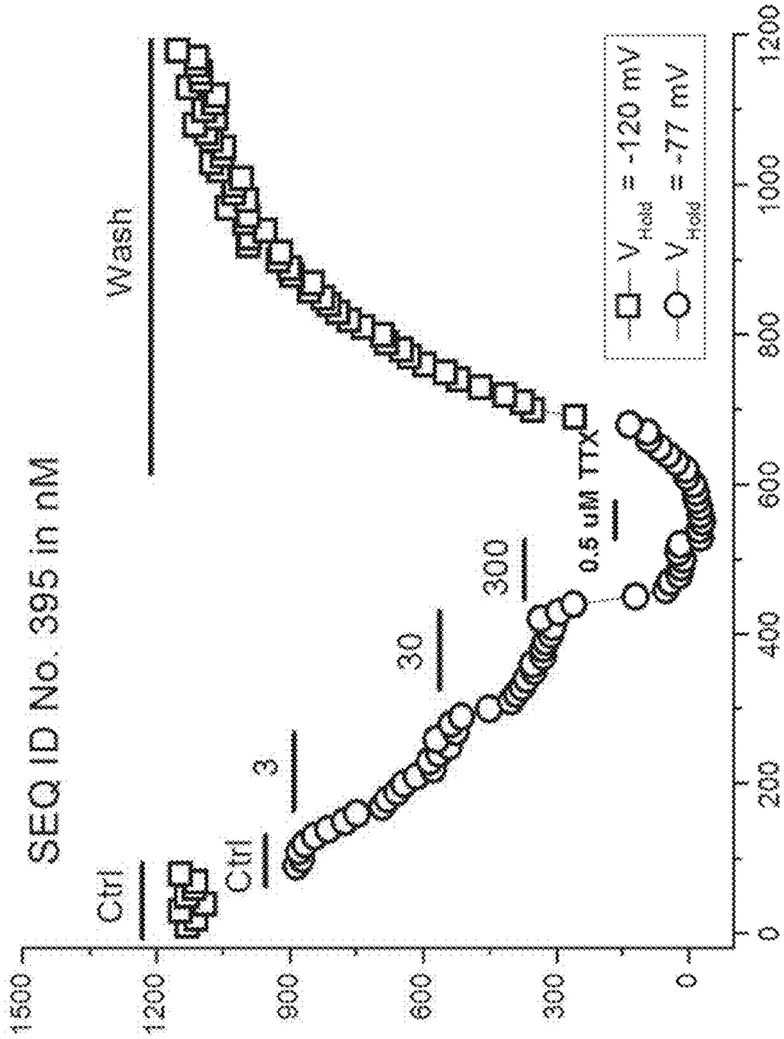

FIG. 130 shows the time course of increasing concentrations of CyA-[Nle6,Pra17,Glu28]JzTx-V(1-29) (Seq ID No. 395) against TTX-sensitive Nay channels in C57 Black 6 mouse DRG neuron. Peak inward Nay currents were measured at −10 mV every 10 seconds in the presence of increasing concentrations of Seq ID No. 395; cell was held at either −120 mV (squares), a voltage where Nav channels are completely non-inactivated, or −77 mV (circles), a voltage that yields approximately 20% inactivation. 'Ctrl' indicates Nav current in the absence of CyA-[Nle6,Pra17, Glu28]JzTx-V(1-29) (Seq ID No. 395), '0.5 μM TTX' indicates Nav current in the presence of 0.5 μM TTX, and 'Wash' indicates Nav current following removal of CyA-[Nle6,Pra17,Glu28]JzTx-V(1-29) (Seq ID No. 395) and TTX.

Figure 131:
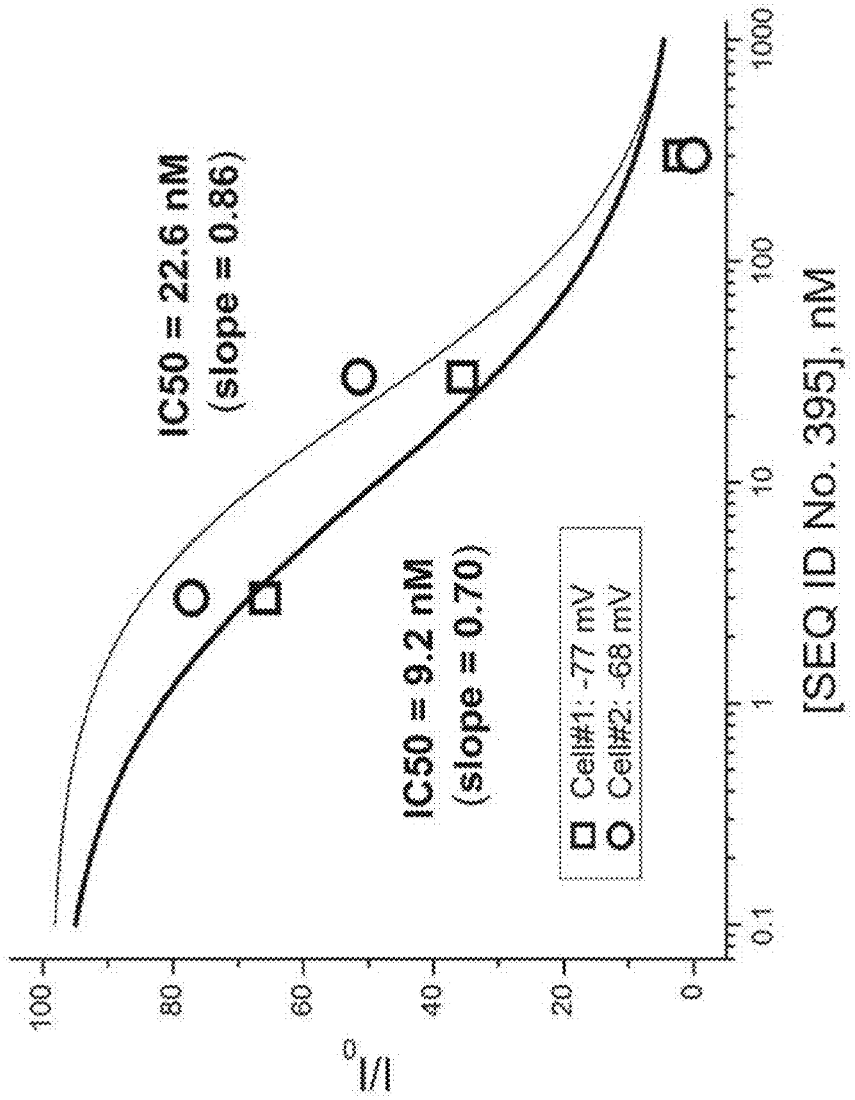

FIG. 131 shows the dose-response curves of CyA-[Nle6, Pra17,Glu28]JzTx-V(1-29) (Seq ID No. 395) against TTX-sensitive Nav channels in two separate C57 Black 6 mouse DRG neurons. Peak inward Nav currents were measured at −10 mV in the presence of increasing concentrations of CyA-[Nle6,Pra17,Glu28]JzTx-V(1-29) (Seq ID No. 395)

and divided by current before Seq ID No. 395 addition ($I/I_0$); cells were held at a voltage that yielded approximately 20% inactivation.

Figure 132:
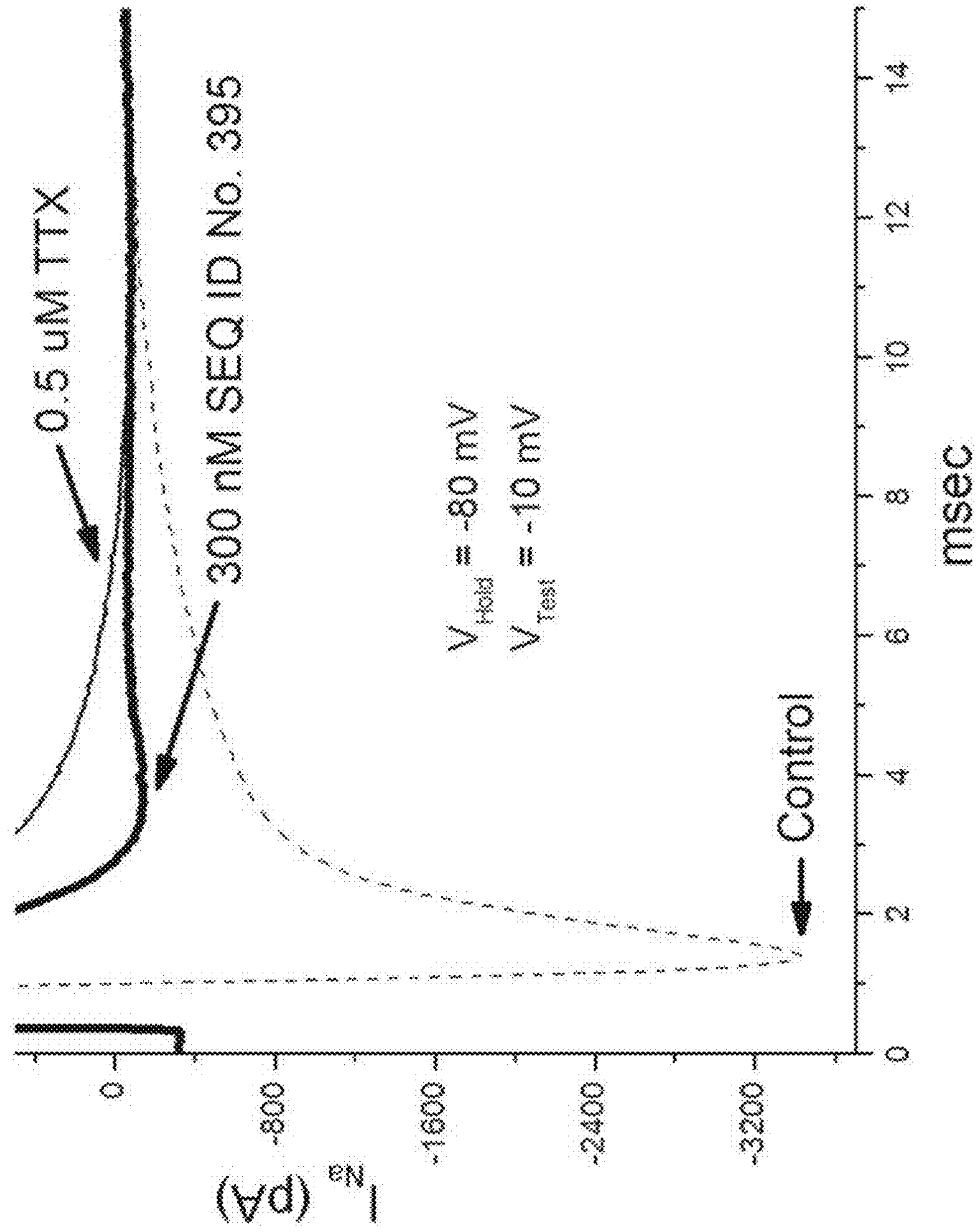

FIG. 132 shows the effect of CyA-[Nle6,Pra17,Glu28]JzTx-V(1-29) (Seq ID No. 395) on TTX-sensitive Nav channels in Sprague Dawley rat DRG neuron. Cell was held at −80 mV and peak inward Nav currents were measured at −10 mV. 'Control' trace shows Nav current before CyA-[Nle6,Pra17,Glu28]JzTx-V(1-29) (Seq ID No. 395), '300 nM Seq ID No. 395' trace shows Nav current after Seq ID No. 395 addition, and '0.5 μM TTX' trace shows Nav current after TTX.

Figure 133:
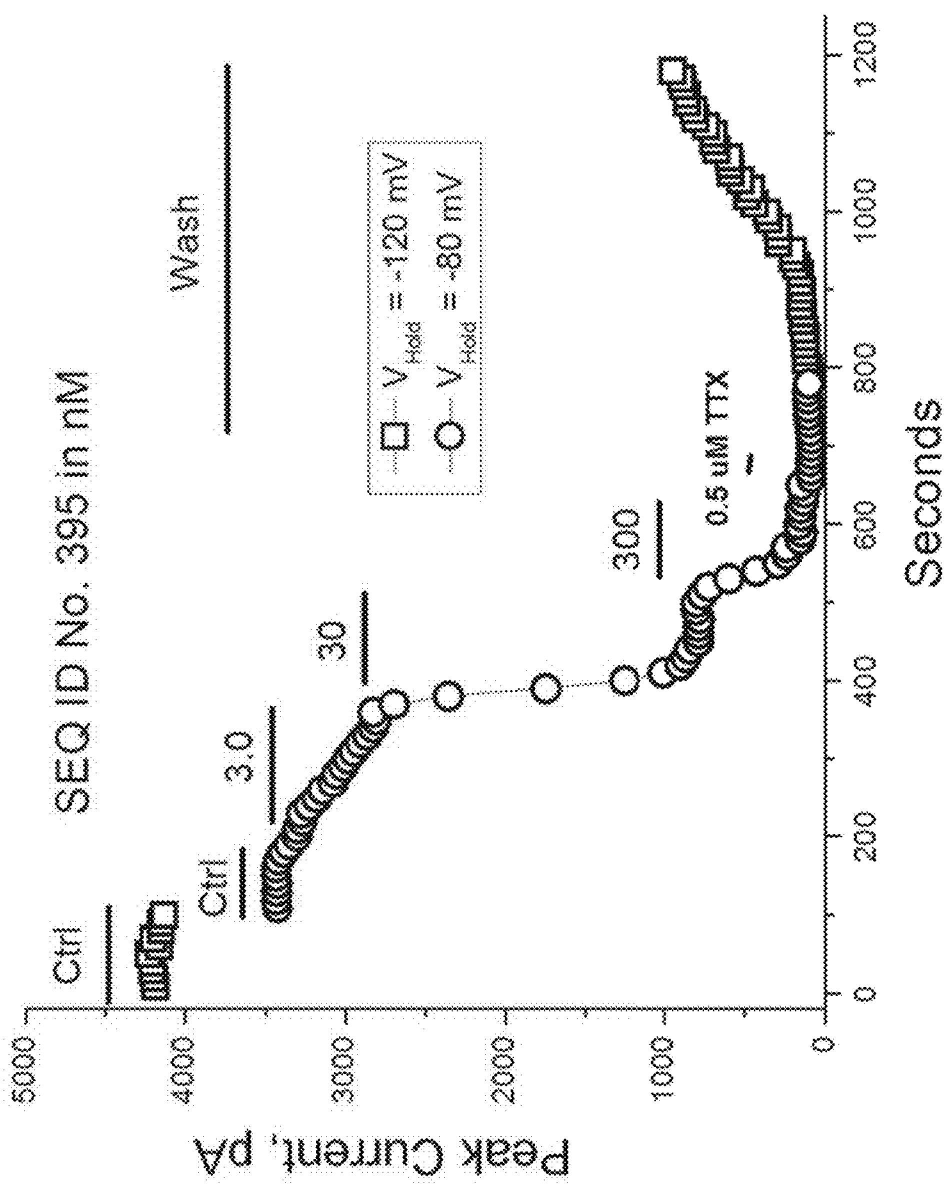

FIG. 133 shows the time course of increasing concentrations of CyA-[Nle6,Pra17,Glu28]JzTx-V(1-29) (Seq ID No. 395) against TTX-sensitive Nav channels in Sprague Dawley rat DRG neuron. Peak inward Nav currents were measured at −10 mV every 10 seconds in the presence of increasing concentrations of CyA-[Nle6,Pra17,Glu28]JzTx-V(1-29) (Seq ID No. 395); cell was held at either −120 mV (squares), a voltage where Nav channels are completely non-inactivated, or −80 mV (circles), a voltage that yields approximately 20% inactivation. 'Ctrl' indicates Nav current in the absence of Seq ID No. 395, '0.5 μM TTX' indicates Nav current in the presence of 0.5 μM TTX, and 'Wash' indicates Nav current following removal of CyA-[Nle6,Pra17,Glu28]JzTx-V(1-29) (Seq ID No. 395) and TTX.

Figure 134:
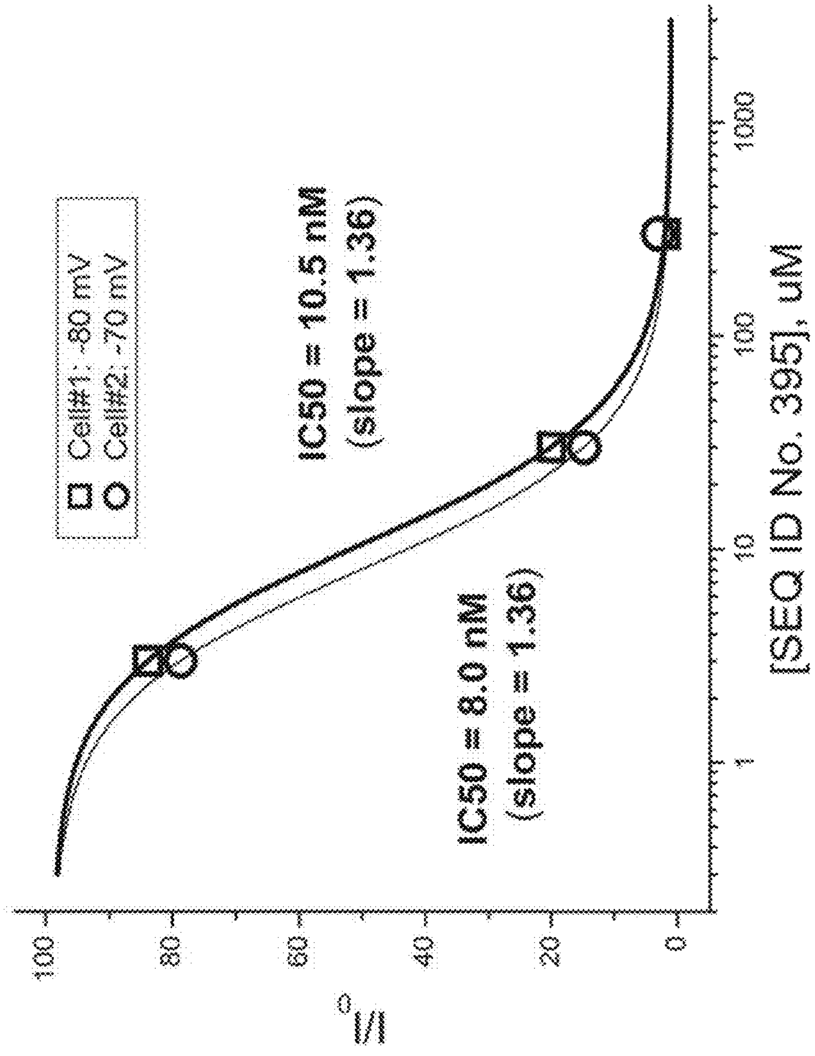

FIG. 134 shows the dose-response curves of CyA-[Nle6,Pra17,Glu28]JzTx-V(1-29) (Seq ID No. 395) against TTX-sensitive Nav channels in two separate Sprague Dawley rat DRG neurons. Peak inward Nav currents were measured at −10 mV in the presence of increasing concentrations of CyA-[Nle6,Pra17,Glu28]JzTx-V(1-29) (Seq ID No. 395) and divided by current before Seq ID No. 395 addition ($I/I_0$); cells were held at a voltage that yielded approximately 20% inactivation.

Figure 135:
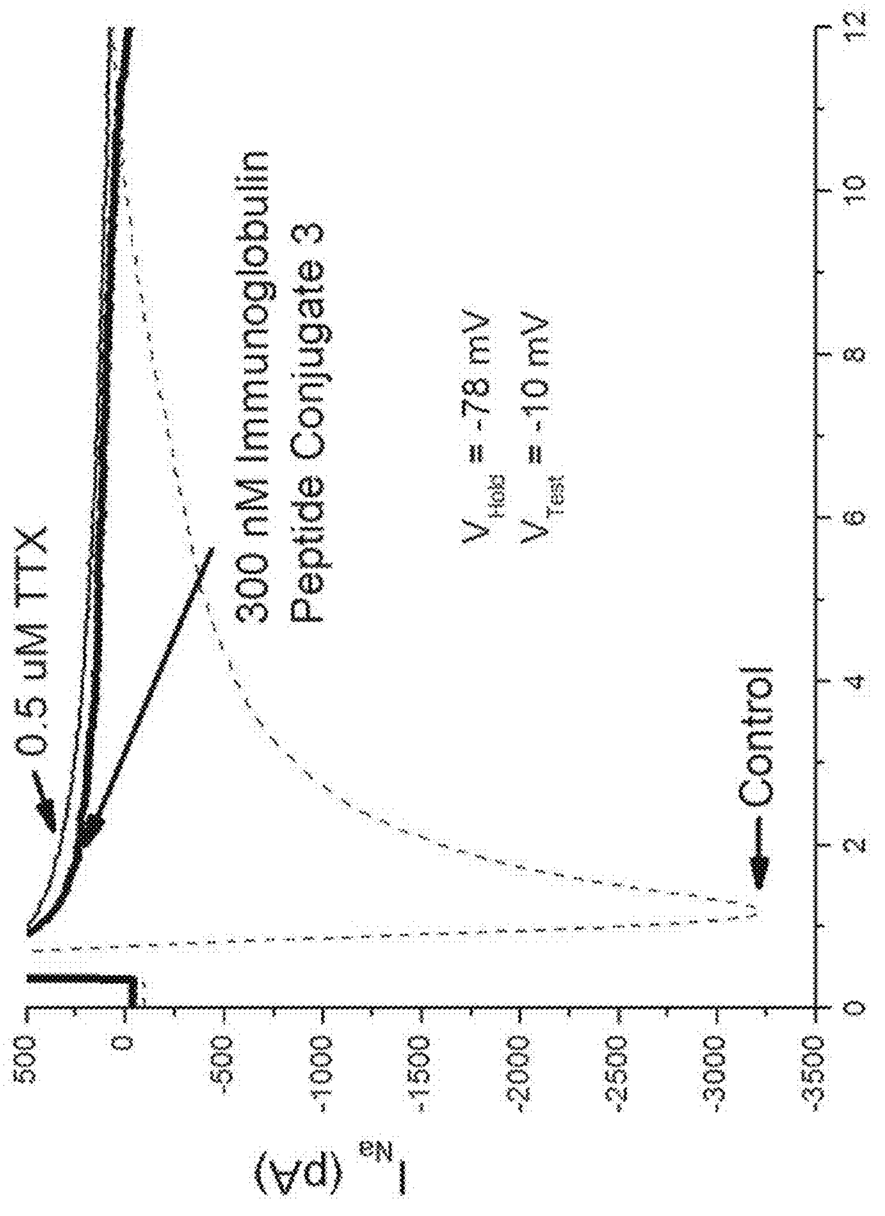

FIG. 135 shows the effect of Immunoglobulin Peptide Conjugate 3 (see, Example 9, Table 21) on TTX-sensitive Nav channels in C57 Black 6 mouse DRG neuron. Cell was held at −78 mV and peak inward Nav currents were measured at −10 mV. 'Control' trace shows Nav current before Immunoglobulin Peptide Conjugate 3, '300 nM Immunoglobulin Peptide Conjugate 3' trace shows Nav current after Immunoglobulin Peptide Conjugate 3 addition, and '0.5 μM TTX' trace shows Nav current after TTX. Note that 300 nM Immunoglobulin Peptide Conjugate 3 blocks the majority of TTX-sensitive Nav current.

Figure 136:
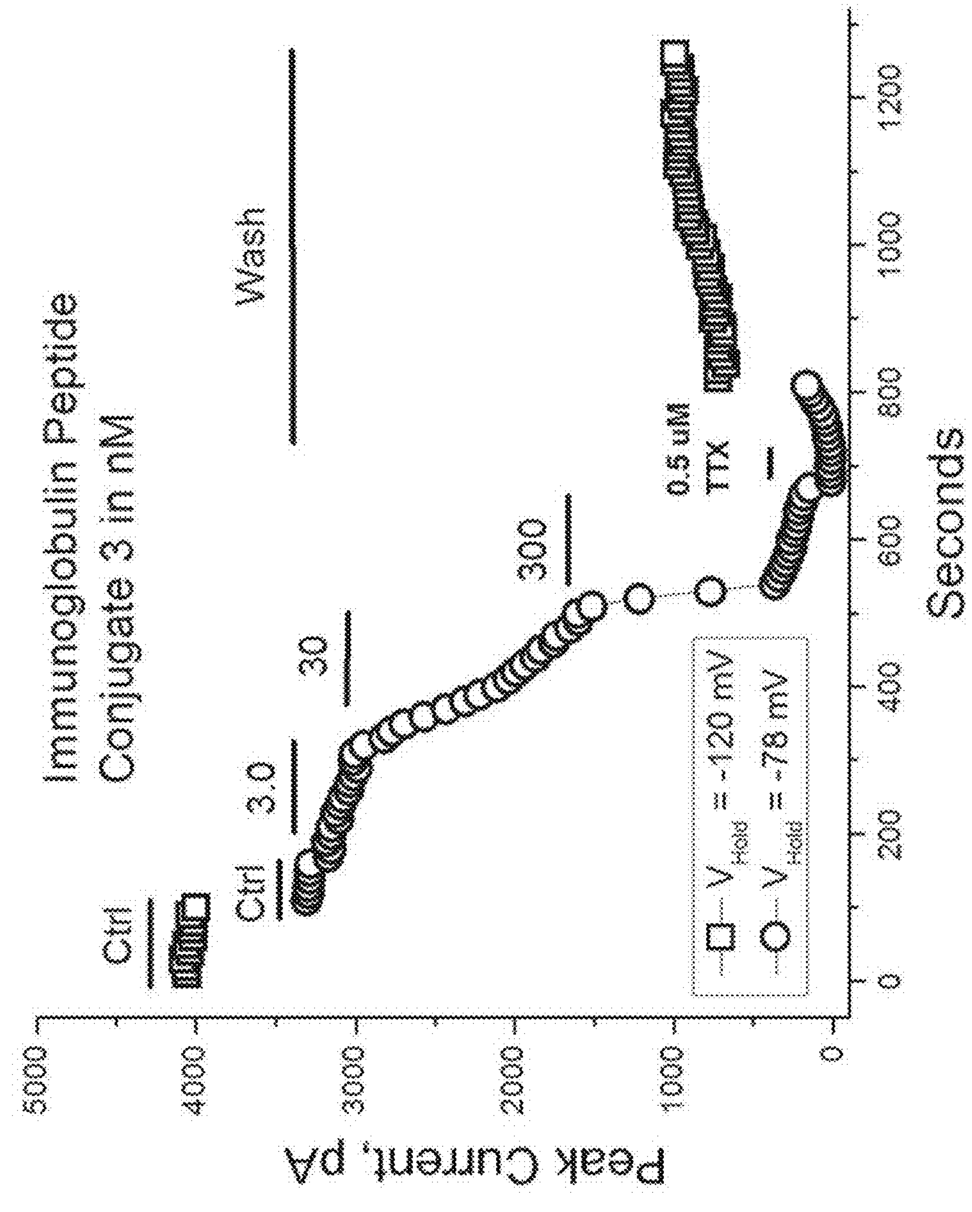

FIG. 136 shows the time course of increasing concentrations of Immunoglobulin Peptide Conjugate 3 (see, Example 9, Table 21) against TTX-sensitive Nav channels in C57 Black 6 mouse DRG neuron. Peak inward Nav currents were measured at −10 mV every 10 seconds in the presence of increasing concentrations of Immunoglobulin Peptide Conjugate 3; cell was held at either −120 mV (squares), a voltage where Nav channels are completely non-inactivated, or −78 mV (circles), a voltage that yields approximately 20% inactivation. 'Ctrl' indicates Nav current in the absence of Immunoglobulin Peptide Conjugate 3, '0.5 μM TTX' indicates Nav current in the presence of 0.5 μM TTX, and 'Wash' indicates Nav current following removal of Immunoglobulin Peptide Conjugate 3 and TTX.

Figure 137:
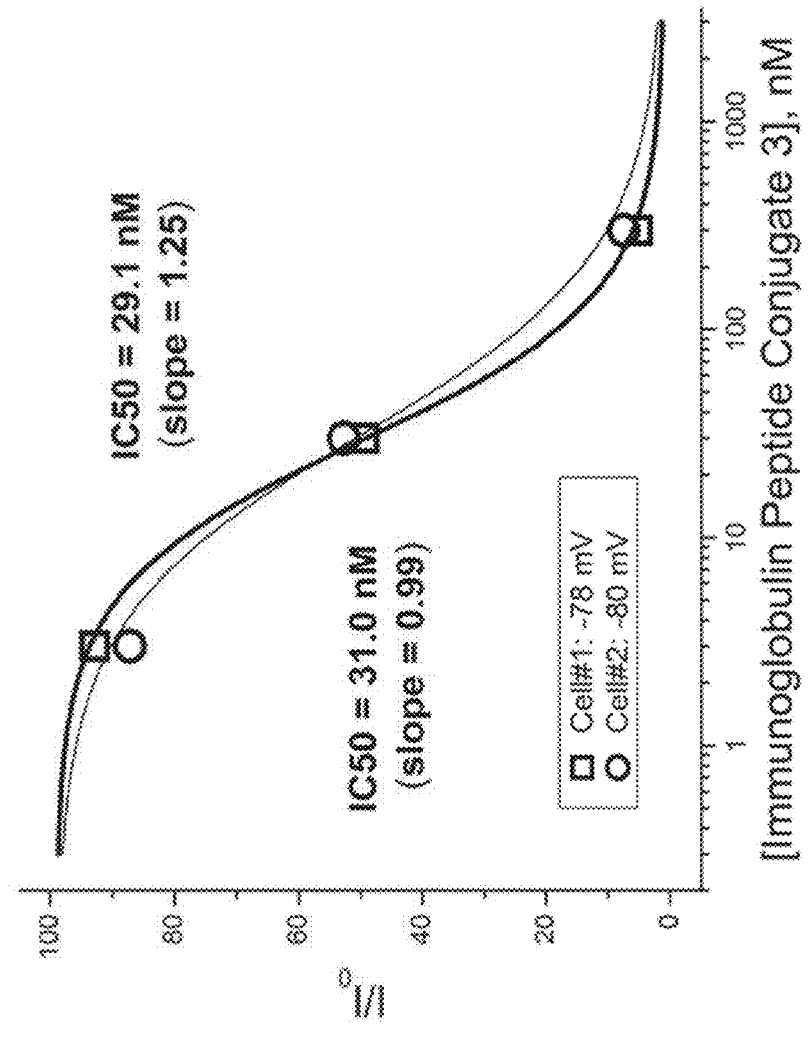

FIG. 137 shows the dose-response curves of Immunoglobulin Peptide Conjugate 3 (see, Example 9, Table 21) against TTX-sensitive Nav channels in two separate C57 Black 6 mouse DRG neurons. Peak inward Nav currents were measured at −10 mV in the presence of increasing concentrations of Immunoglobulin Peptide Conjugate 3 and divided by current before Immunoglobulin Peptide Conjugate 3 addition ($I/I_0$); cells were held at a voltage that yielded approximately 20% inactivation.

Figure 138:
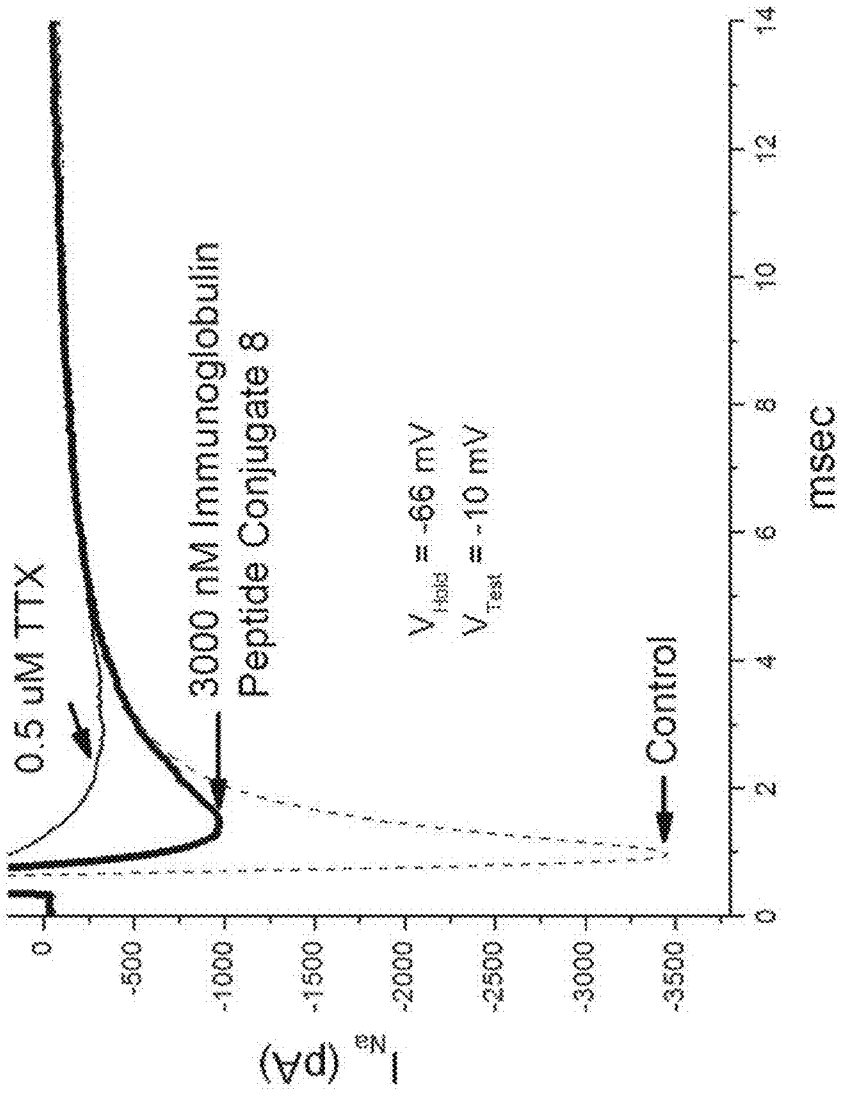

FIG. 138 shows the effect of Immunoglobulin Peptide Conjugate 8 (see, Example 9, Table 21) on TTX-sensitive Nav channels in C57 Black 6 mouse DRG neuron. Cell was held at −66 mV and peak inward Nav currents were measured at −10 mV. 'Control' trace shows Nav current before Immunoglobulin Peptide Conjugate 8, '3000 nM Immunoglobulin Peptide Conjugate 8' trace shows Nav current after Immunoglobulin Peptide Conjugate 8 addition, and '0.5 μM TTX' trace shows Nav current after TTX. Note that 3000 nM Immunoglobulin Peptide Conjugate 8 blocks over 75% of TTX-sensitive Nav current and 0.5 μM TTX completely blocks TTX-sensitive Nav current.

Figure 139:
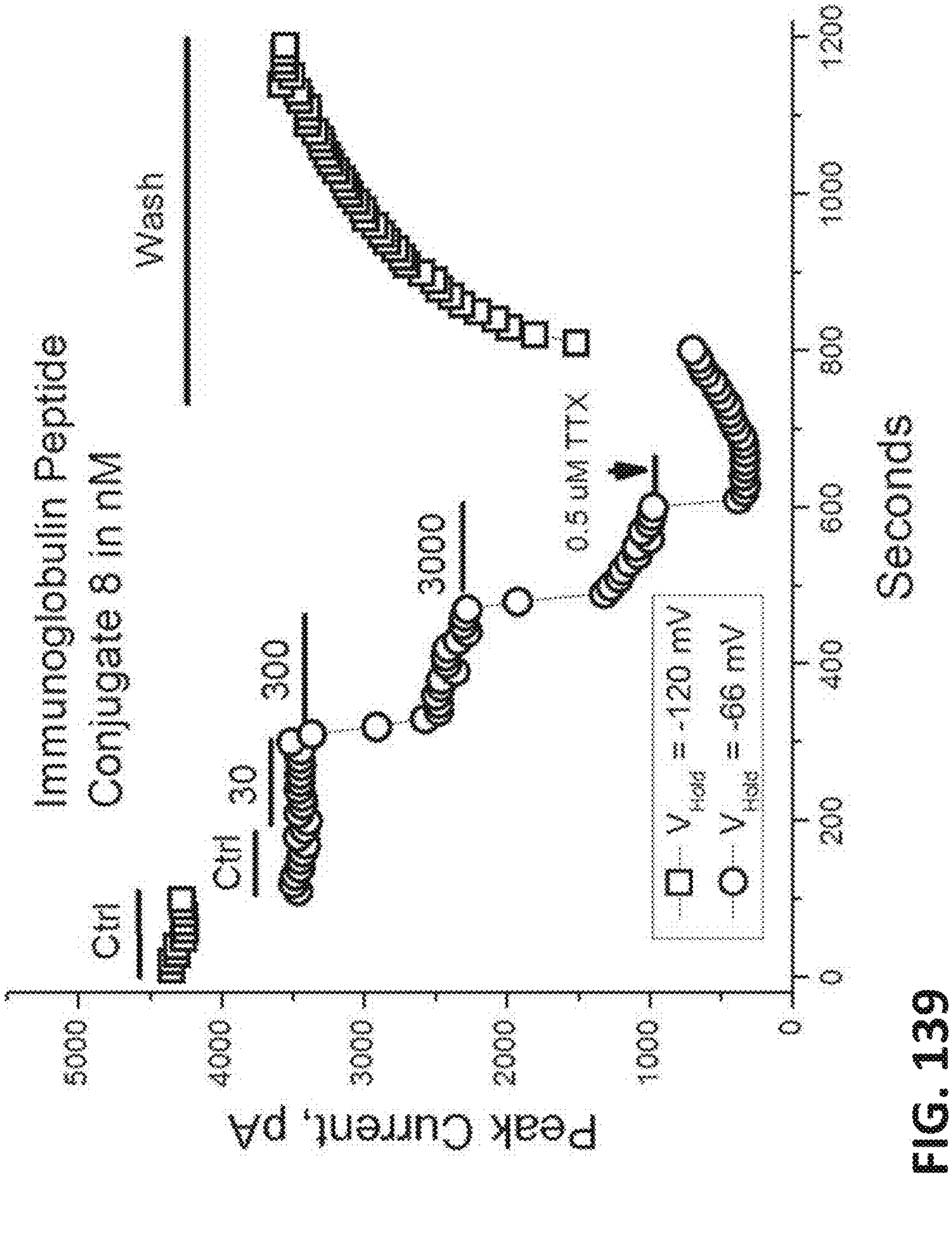

FIG. 139 shows the time course of increasing concentrations of Immunoglobulin Peptide Conjugate 8 (see, Example 9, Table 21) against TTX-sensitive Nav channels in C57 Black 6 mouse DRG neuron. Peak inward Nav currents were measured at −10 mV every 10 seconds in the presence of increasing concentrations of Immunoglobulin Peptide Conjugate 8; cell was held at either −120 mV (squares), a voltage where Nav channels are completely non-inactivated, or −66 mV (circles), a voltage that yields approximately 20% inactivation. 'Ctrl' indicates Nav current in the absence of Immunoglobulin Peptide Conjugate 8, '0.5 μM TTX' indicates Nav current in the presence of 0.5 μM TTX, and 'Wash' indicates Nav current following removal of Immunoglobulin Peptide Conjugate 8 and TTX.

Figure 140:
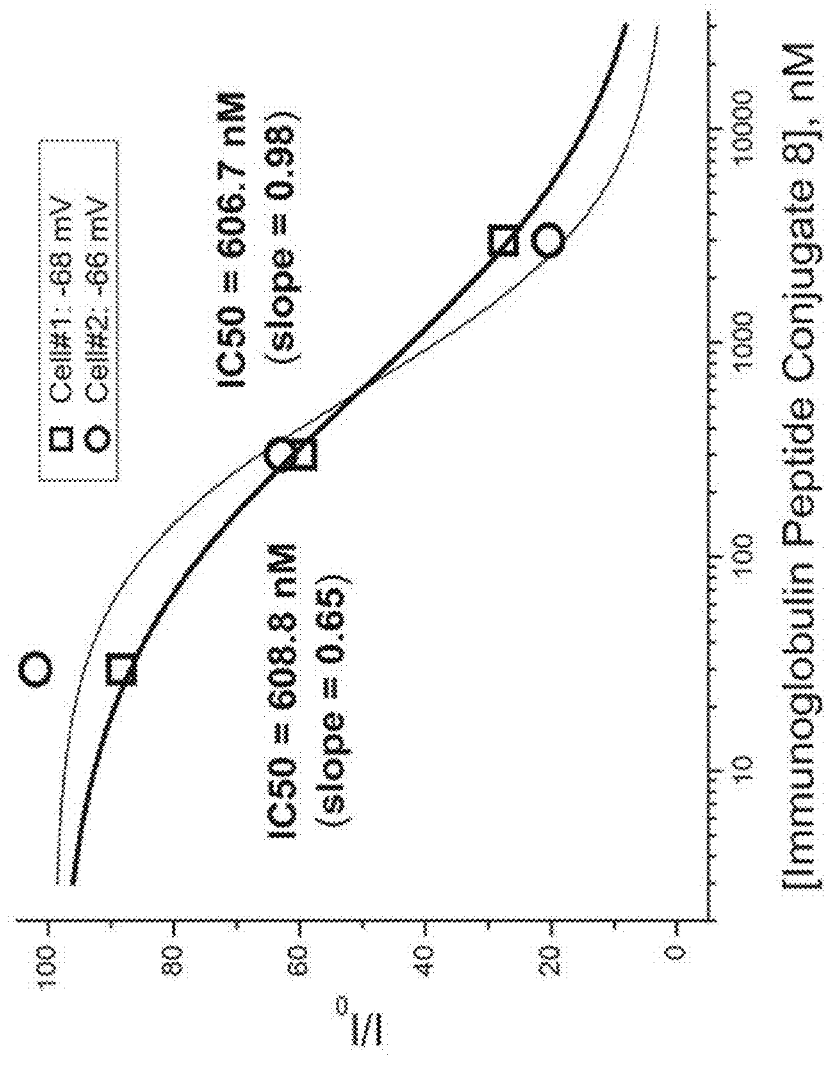

FIG. 140 shows the dose-response curves of Immunoglobulin Peptide Conjugate 8 (see, Example 9, Table 21) against TTX-sensitive Nav channels in two separate C57 Black 6 mouse DRG neurons. Peak inward Nav currents were measured at −10 mV in the presence of increasing concentrations of Immunoglobulin Peptide Conjugate 8 and divided by current before Immunoglobulin Peptide Conjugate 8 addition ($I/I_0$); cells were held at a voltage that yielded approximately 20% inactivation.

Figure 141:
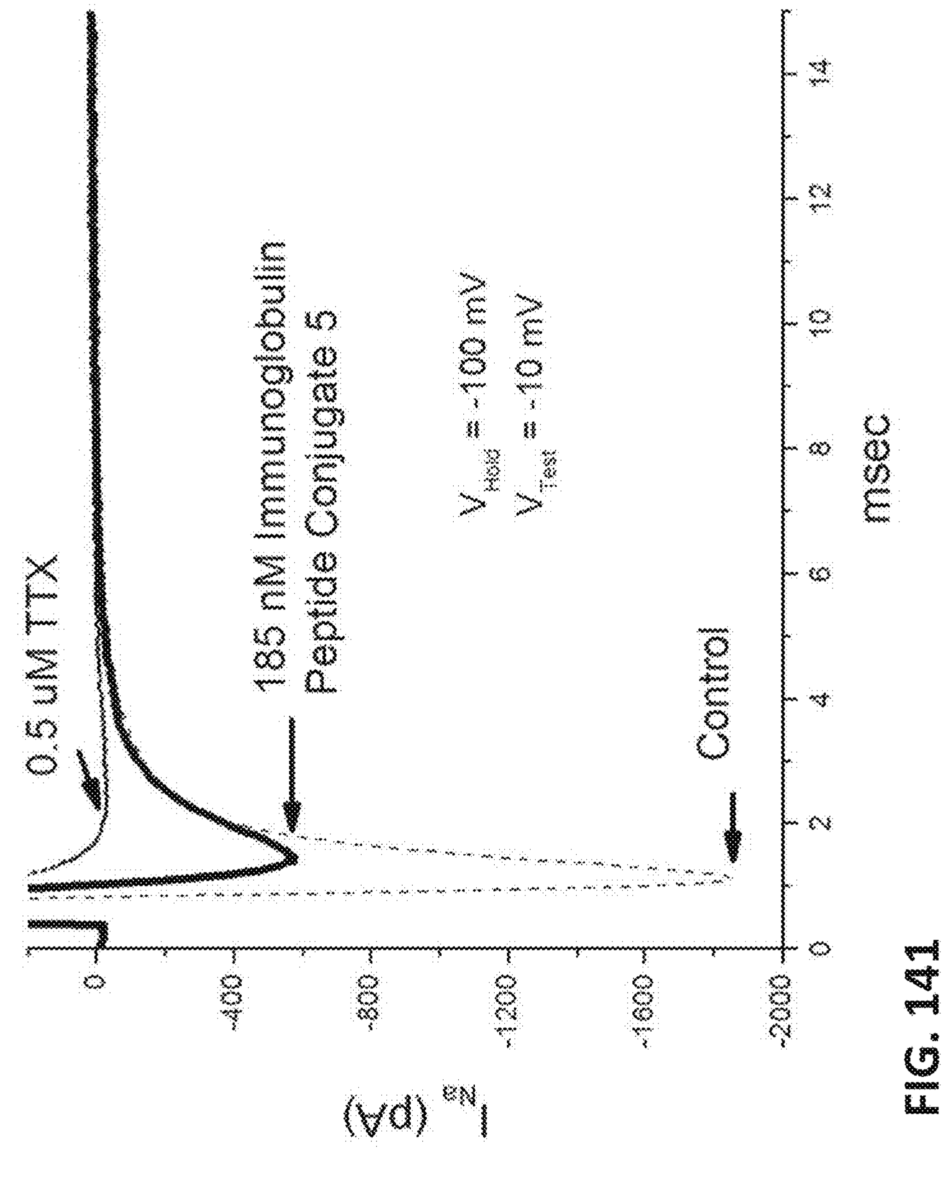

FIG. 141 shows the effect of Immunoglobulin Peptide Conjugate 5 (see, Example 9, Table 21) on TTX-sensitive Nav channels in C57 Black 6 mouse DRG neuron. Cell was held at −100 mV and peak inward Nav currents were measured at −10 mV. 'Control' trace shows Nav current before Immunoglobulin Peptide Conjugate 5, '185 nM Immunoglobulin Peptide Conjugate 5' trace shows Nav current after Immunoglobulin Peptide Conjugate 5 addition, and '0.5 μM TTX' trace shows Nav current after TTX. Note that 185 nM Immunoglobulin Peptide Conjugate 5 blocks approximately 70% of TTX-sensitive Nav current and 0.5 μM TTX completely blocks TTX-sensitive Nav current.

Figure 142:
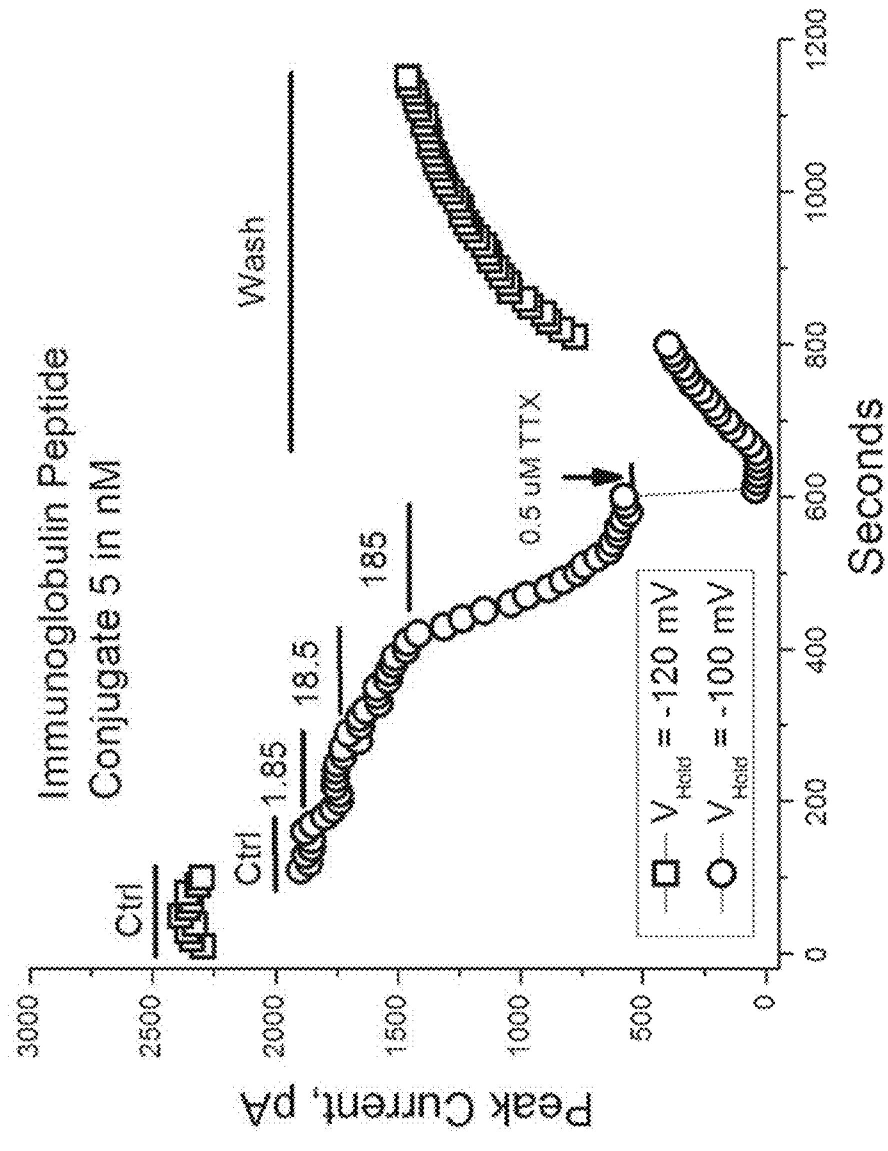

FIG. 142 shows the time course of increasing concentrations of Immunoglobulin Peptide Conjugate 5 (see, Example 9, Table 21) against TTX-sensitive Nav channels in C57 Black 6 mouse DRG neuron. Peak inward Nav currents were measured at −10 mV every 10 seconds in the presence of increasing concentrations of Immunoglobulin Peptide Conjugate 5; cell was held at either −120 mV (squares), a voltage where Nav channels are completely non-inactivated, or −100 mV (circles), a voltage that yields approximately 20% inactivation. 'Ctrl' indicates Nav current in the absence of Immunoglobulin Peptide Conjugate 5, '0.5 μM TTX' indicates Nav current in the presence of 0.5 μM TTX, and 'Wash' indicates Nav current following removal of Immunoglobulin Peptide Conjugate 5 and TTX.

Figure 143:
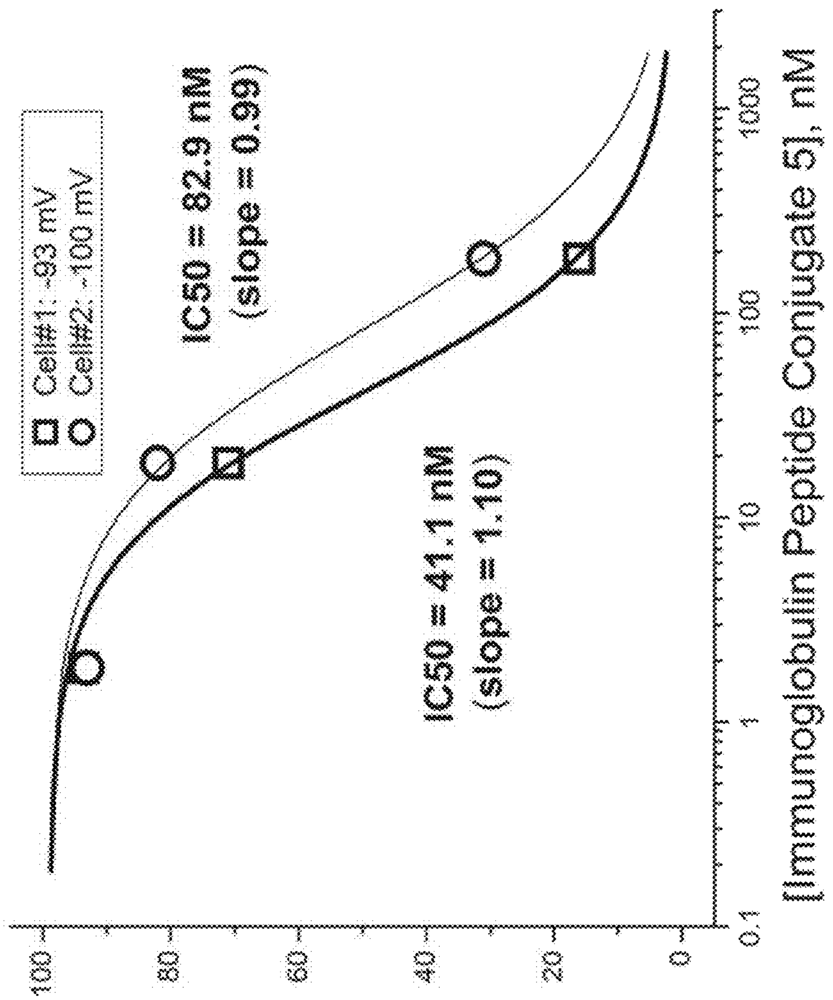

FIG. 143 shows the dose-response curves of Immunoglobulin Peptide Conjugate 5 (see, Example 9, Table 21) against TTX-sensitive Nav channels in two separate C57 Black 6 mouse DRG neurons. Peak inward Nav currents were measured at −10 mV in the presence of increasing concentrations of Immunoglobulin Peptide Conjugate 5 and divided by current before Immunoglobulin Peptide Conjugate 5 addition ($I/I_0$); cells were held at a voltage that yielded approximately 20% inactivation.

Figure 144:
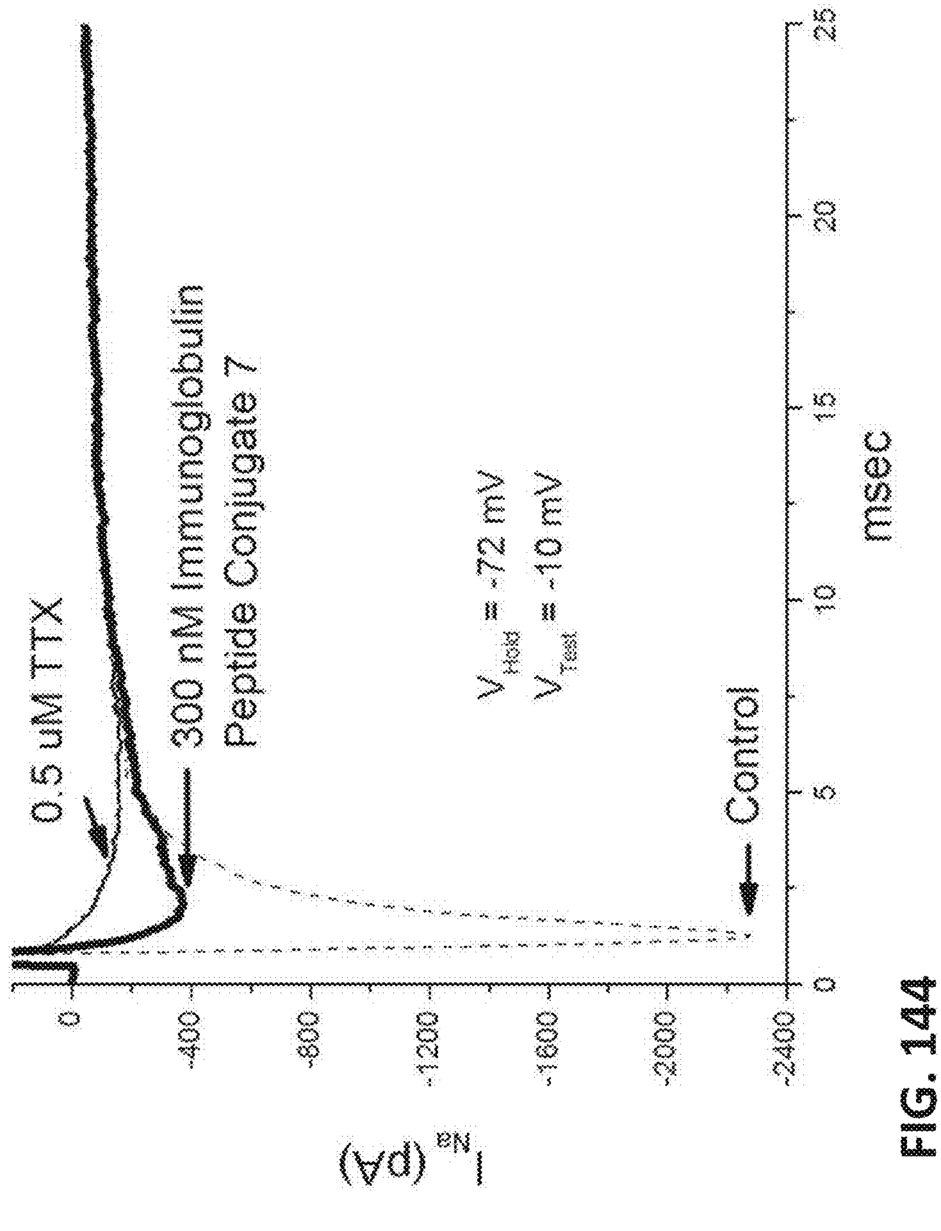

FIG. 144 shows the effect of Immunoglobulin Peptide Conjugate 7 (see, Example 9, Table 21) on TTX-sensitive Nav channels in C57 Black 6 mouse DRG neuron. Cell was held at −72 mV and peak inward Nav currents were measured at −10 mV. 'Control' trace shows Nav current before Immunoglobulin Peptide Conjugate 7, '300 nM Immunoglobulin Peptide Conjugate 7' trace shows Nav current after Immunoglobulin Peptide Conjugate 7 addition, and '0.5 μM TTX' trace shows Nav current after TTX. Note that 300 nM Immunoglobulin Peptide Conjugate 7 blocks approximately 90% of TTX-sensitive Nav current.

Figure 145:
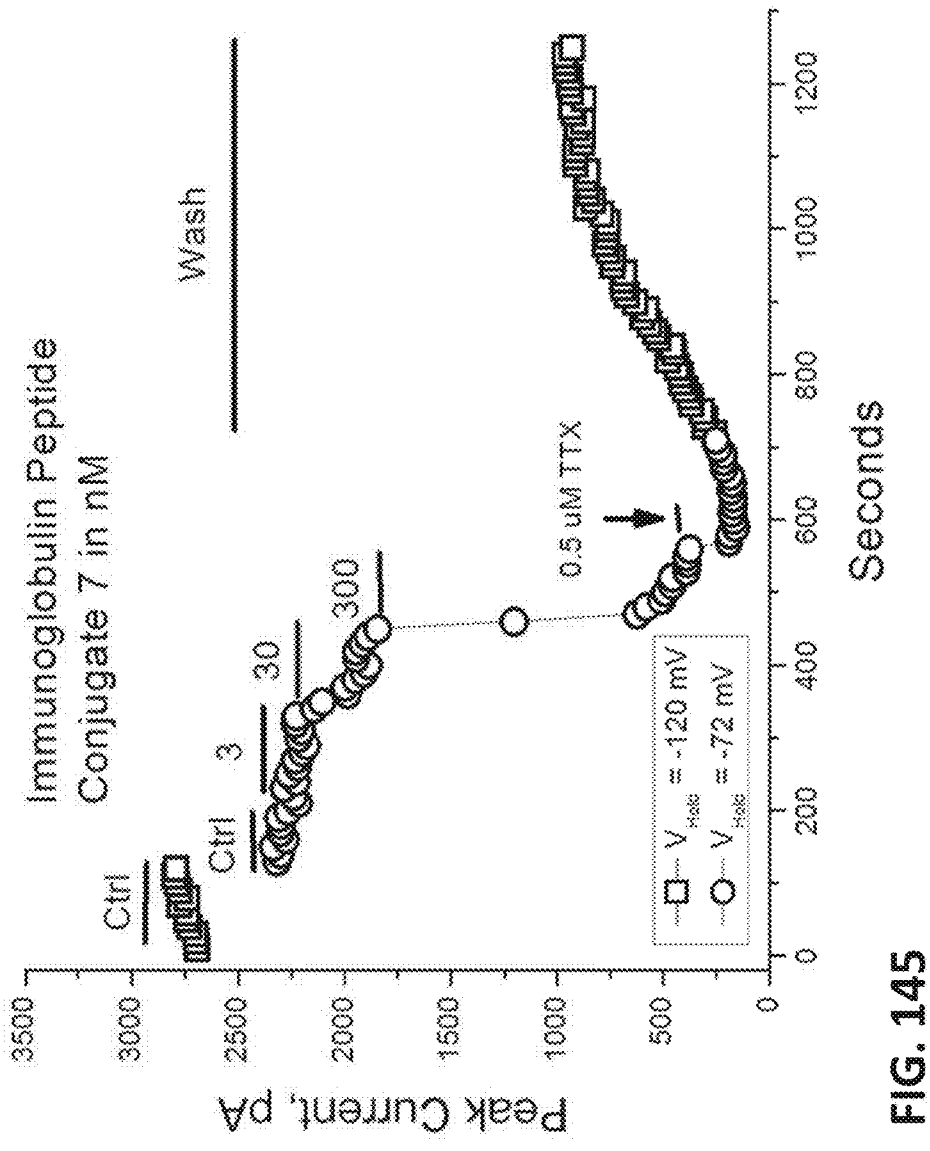

FIG. 145 shows the time course of increasing concentrations of Immunoglobulin Peptide Conjugate 7 (see, Example 9, Table 21) against TTX-sensitive Nav channels in C57 Black 6 mouse DRG neuron. Peak inward Nav currents were measured at −10 mV every 10 seconds in the presence of increasing concentrations of Immunoglobulin Peptide Conjugate 7; cell was held at either −120 mV (squares), a voltage where Nav channels are completely non-inactivated, or −72 mV (circles), a voltage that yields approximately 20% inactivation. 'Ctrl' indicates Nav current in the absence of Immunoglobulin Peptide Conjugate 7, '0.5 μM TTX' indicates Nav current in the presence of 0.5 μM TTX, and 'Wash' indicates Nav current following removal of Immunoglobulin Peptide Conjugate 7 and TTX.

Figure 146:
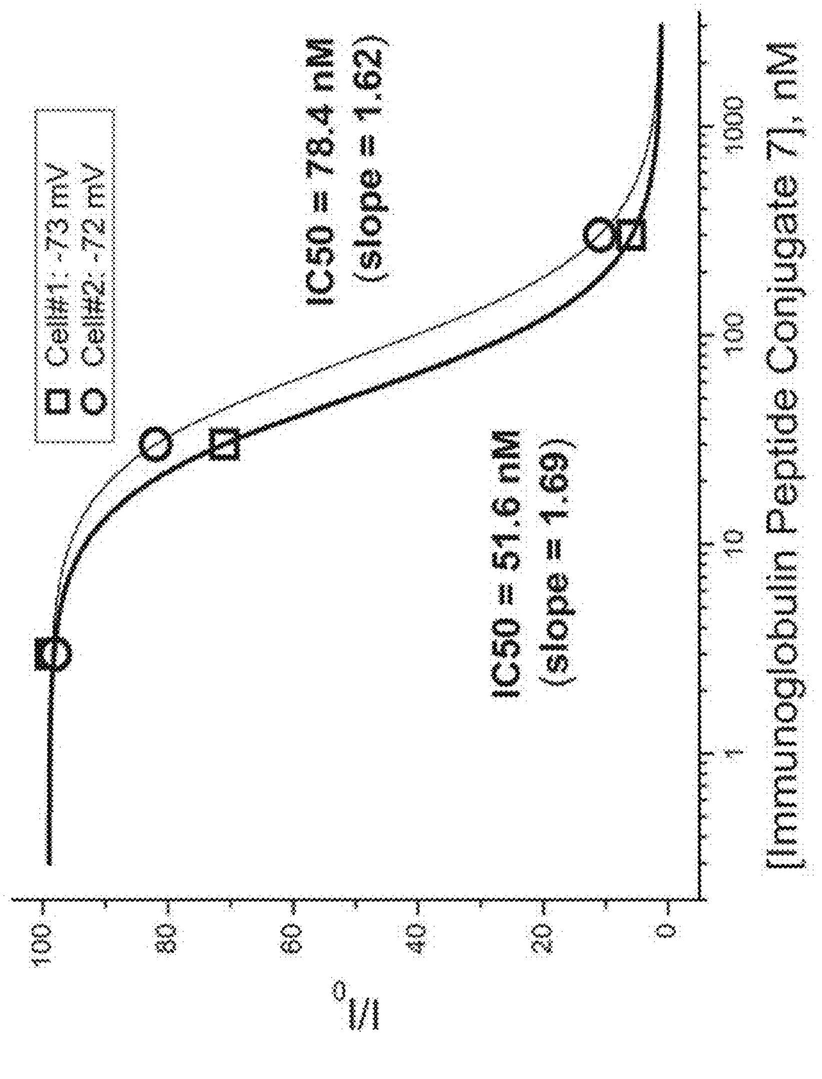

FIG. 146 shows the dose-response curves of Immunoglobulin Peptide Conjugate 7 (see, Example 9, Table 21) against TTX-sensitive Nav channels in two separate C57 Black 6 mouse DRG neurons. Peak inward Nav currents were measured at −10 mV in the presence of increasing concentrations of Immunoglobulin Peptide Conjugate 7 and divided by current before Immunoglobulin Peptide Conjugate 7 addition ($I/I_0$); cells were held at a voltage that yielded approximately 20% inactivation.

Figure 147:
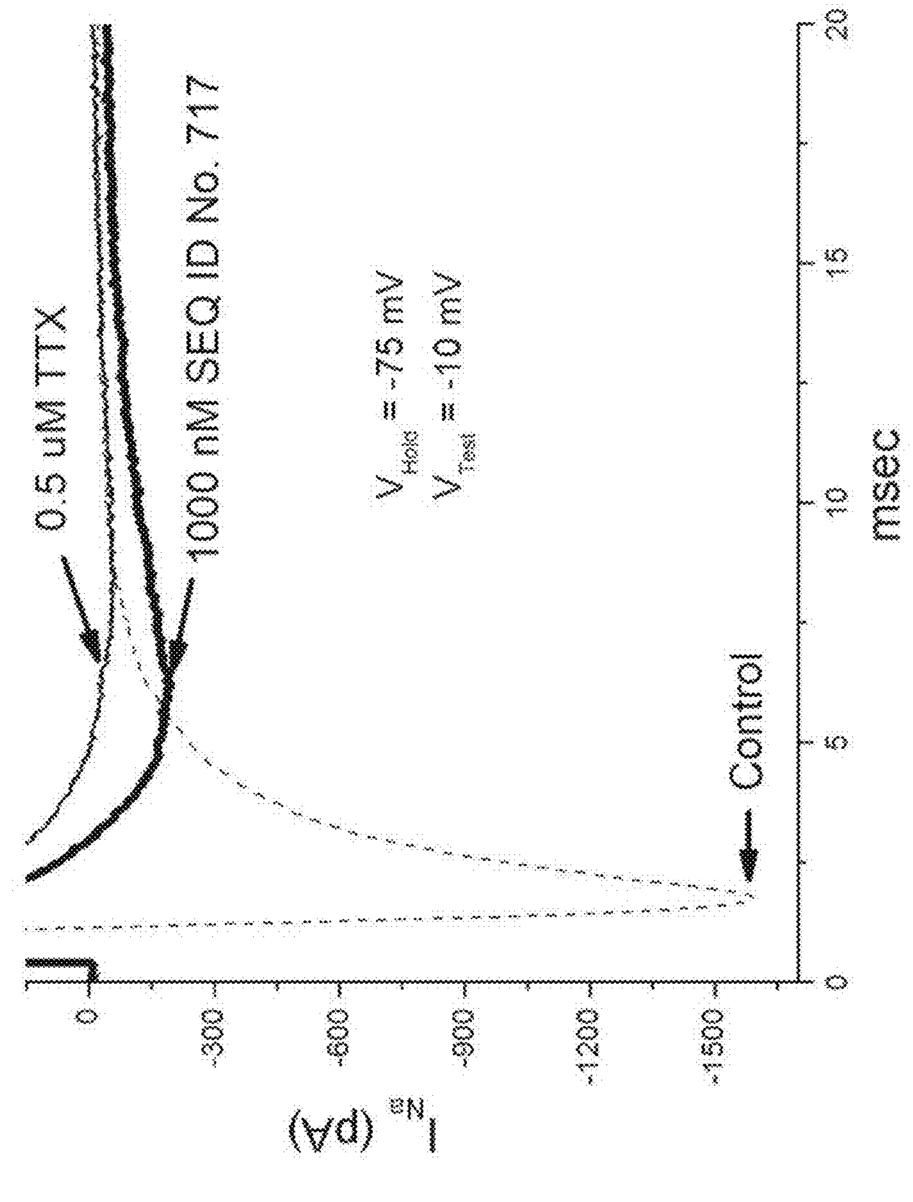

FIG. 147 shows the effect of Pra-[Nle6; Glu14,28]JzTx-V(1-29) (Seq ID No. 717) on TTX-sensitive Nav channels in C57 Black 6 mouse DRG neuron. Cell was held at −75 mV and peak inward Nav currents were measured at −10 mV. 'Control' trace shows Nav current before Seq ID No. 717, '1000 nM Seq ID No. 717' trace shows Nav current after Pra-[Nle6; Glu14,28]JzTx-V(1-29) (Seq ID No. 717) addition, and '0.5 μM TTX' trace shows Nav current after TTX. Note that 1000 nM Pra-[Nle6; Glu14,28]JzTx-V(1-29) (Seq ID No. 717) blocks approximately 90% of TTX-sensitive Nav current.

Figure 148:
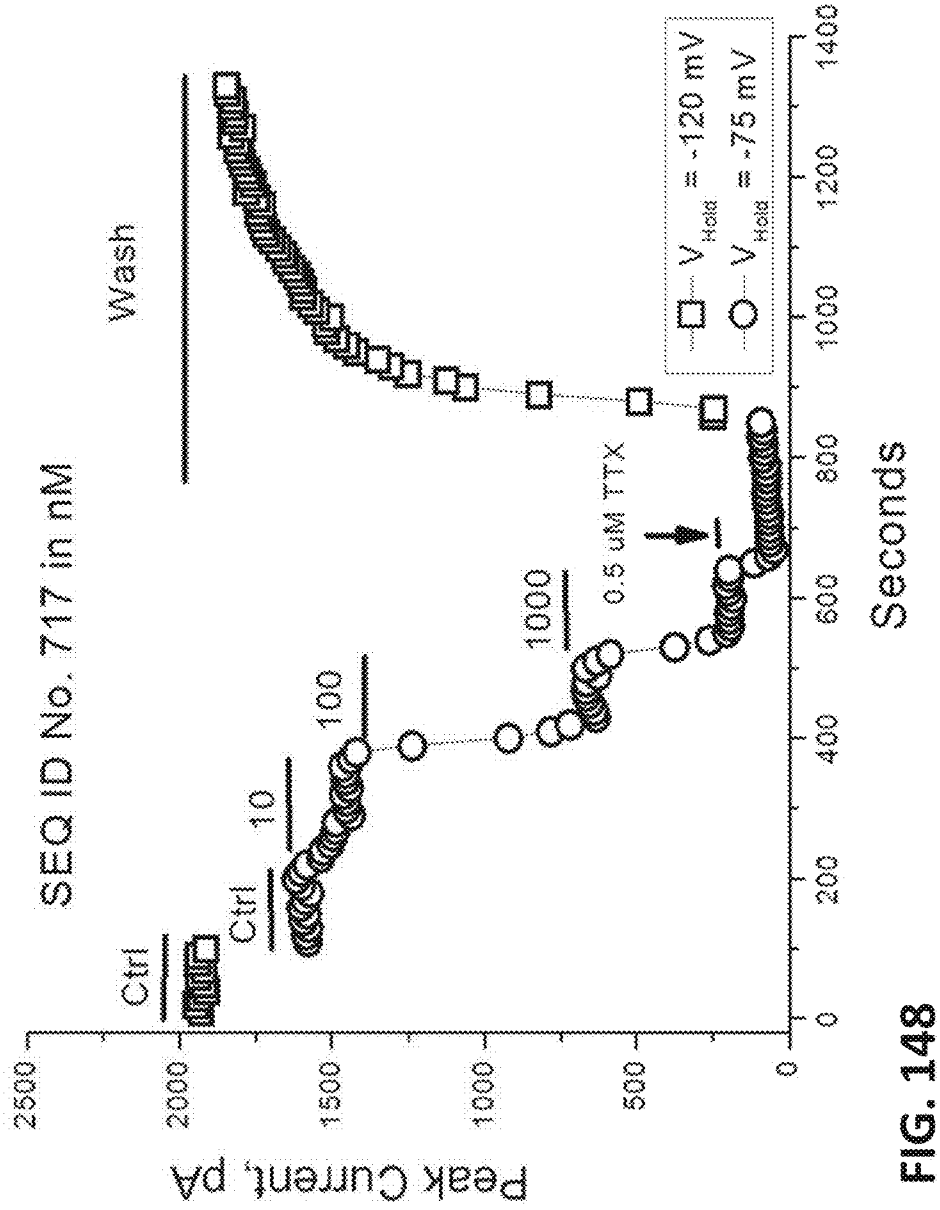

FIG. 148 shows the time course of increasing concentrations of Pra-[Nle6; Glu14,28]JzTx-V(1-29) (Seq ID No. 717) against TTX-sensitive Nav channels in C57 Black 6 mouse DRG neuron. Peak inward Nav currents were measured at −10 mV every 10 seconds in the presence of increasing concentrations of Pra-[Nle6; Glu14,28]JzTx-V (1-29) (Seq ID No. 717); cell was held at either −120 mV (squares), a voltage where Nav channels are completely non-inactivated, or −75 mV (circles), a voltage that yields approximately 20% inactivation. 'Ctrl' indicates Nav current in the absence of Seq ID No. 717, '0.5 μM TTX' indicates Nav current in the presence of 0.5 μM TTX, and 'Wash' indicates Nav current following removal of Pra-[Nle6; Glu14,28]JzTx-V(1-29) (Seq ID No. 717) and TTX.

Figure 149:
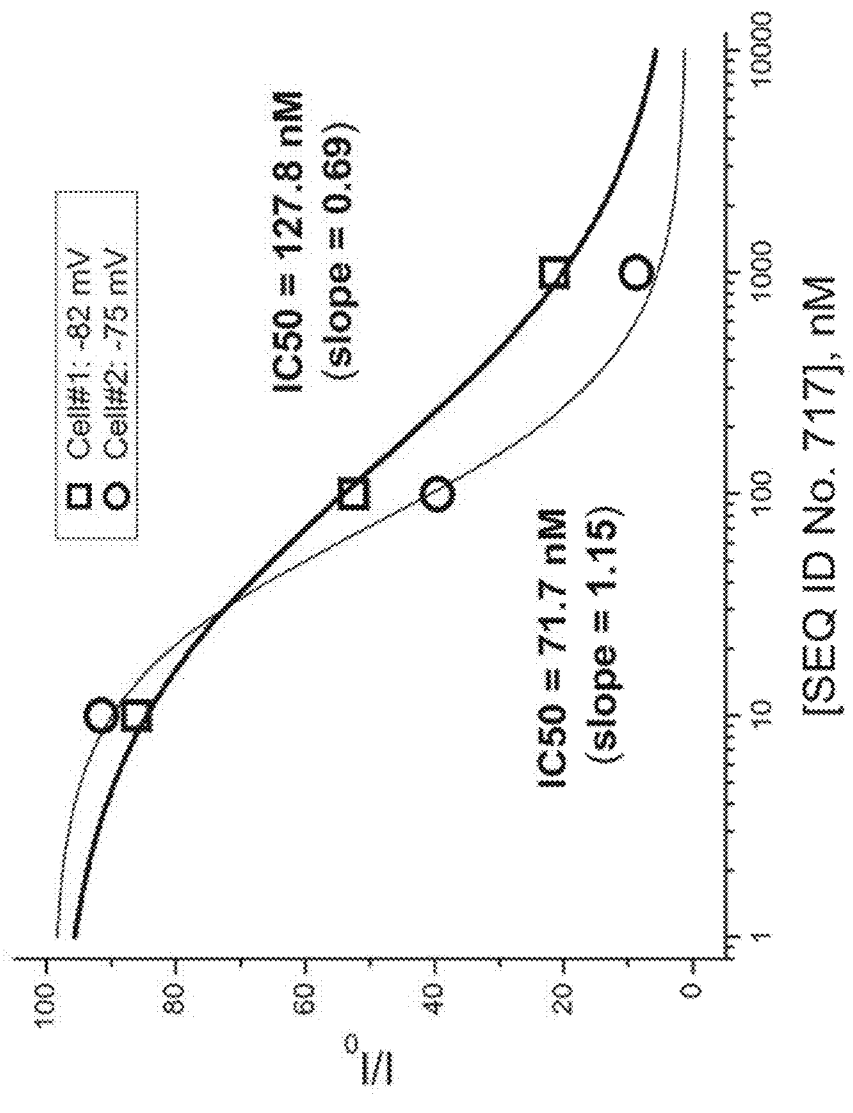

FIG. 149 shows the dose-response curves of Pra-[Nle6; Glu14,28]JzTx-V(1-29) (Seq ID No. 717) against TTX-sensitive Nav channels in two separate C57 Black 6 mouse DRG neurons. Peak inward Nav currents were measured at −10 mV in the presence of increasing concentrations of Pra-[Nle6; Glu14,28]JzTx-V(1-29) (Seq ID No. 717) and divided by current before Seq ID No. 717 addition ($I/I_0$); cells were held at a voltage that yielded approximately 20% inactivation.

Figure 150:
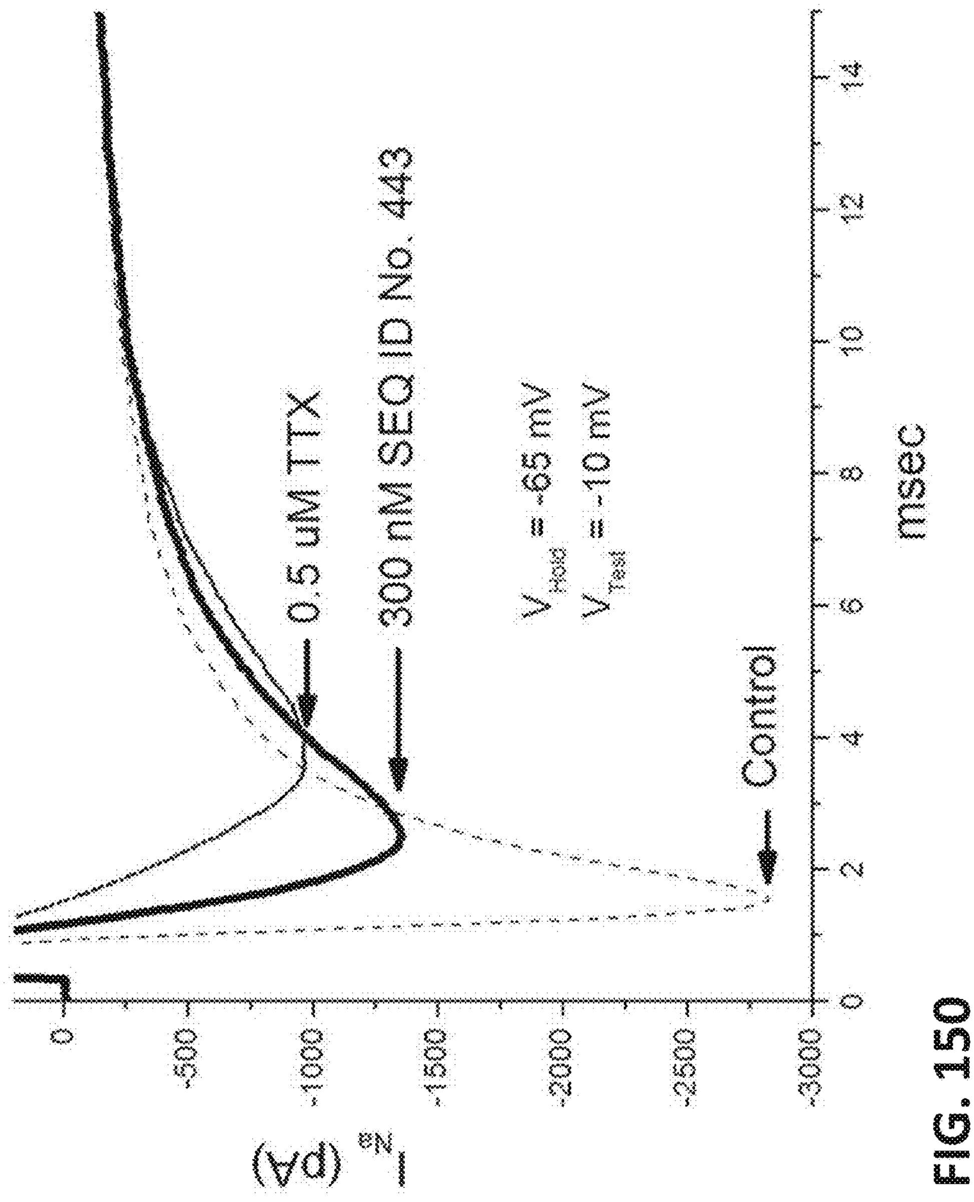

FIG. 150 shows the effect of CyA-[Nle6,Atz(NPEG10)17,Glu28]JzTx-V(1-29) (Seq ID No. 443) on TTX-sensitive Nav channels in C57 Black 6 mouse DRG neuron. Cell was held at −65 mV and peak inward Nav currents were measured at −10 mV. 'Control' trace shows Nav current before CyA-[Nle6,Atz(NPEG10)17,Glu28]JzTx-V(1-29) (Seq ID No. 443), '300 nM Seq ID No. 443' trace shows Nav current after Seq ID No. 443 addition, and '0.5 μM TTX' trace shows Nav current after TTX. Note that 300 nM CyA-[Nle6,Atz(NPEG10)17,Glu28]JzTx-V(1-29) (Seq ID No. 443) blocks over 75% of TTX-sensitive Nav current.

Figure 151:
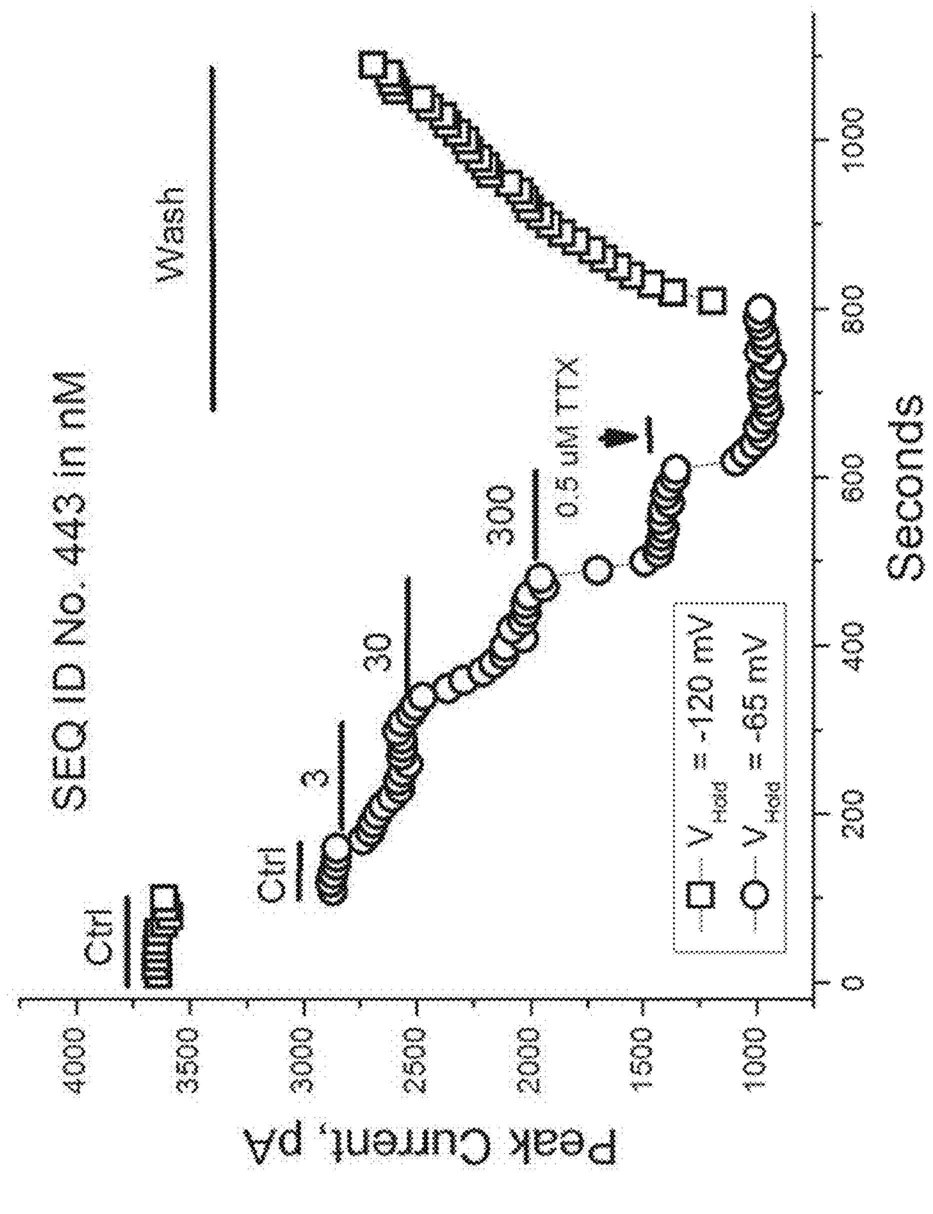

FIG. 151 shows the time course of increasing concentrations of CyA-[Nle6,Atz(NPEG10)17,Glu28]JzTx-V(1-29) (Seq ID No. 443) against TTX-sensitive Nav channels in C57 Black 6 mouse DRG neuron. Peak inward Nav currents were measured at −10 mV every 10 seconds in the presence of increasing concentrations of Seq ID No. 443; cell was held at either −120 mV (squares), a voltage where Nav channels are completely non-inactivated, or −65 mV (circles), a voltage that yields approximately 20% inactivation. 'Ctrl' indicates Nav current in the absence of CyA-[Nle6,Atz(NPEG10)17,Glu28]JzTx-V(1-29) (Seq ID No. 443); '0.5 μM TTX' indicates Nav current in the presence of 0.5 μM TTX, and 'Wash' indicates Nav current following removal of Seq ID No. 443 and TTX.

Figure 152:
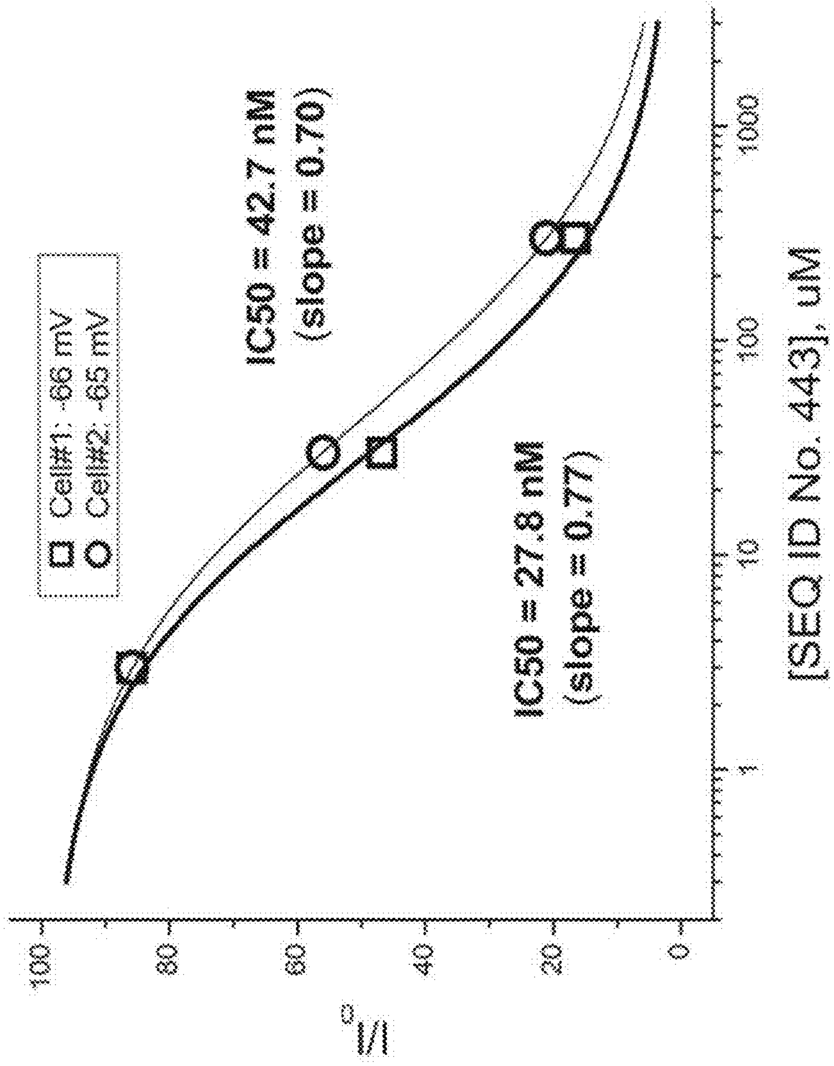

FIG. 152 shows the dose-response curves of CyA-[Nle6,Atz(NPEG10)17,Glu28]JzTx-V(1-29) (Seq ID No. 443) against TTX-sensitive Nav channels in two separate C57 Black 6 mouse DRG neurons. Peak inward Nav currents were measured at −10 mV in the presence of increasing concentrations of Seq ID No. 443 and divided by current before CyA-[Nle6,Atz(NPEG10)17,Glu28]JzTx-V(1-29) (Seq ID No. 443) addition ($I/I_0$); cells were held at a voltage that yielded approximately 20% inactivation.

Figure 153:
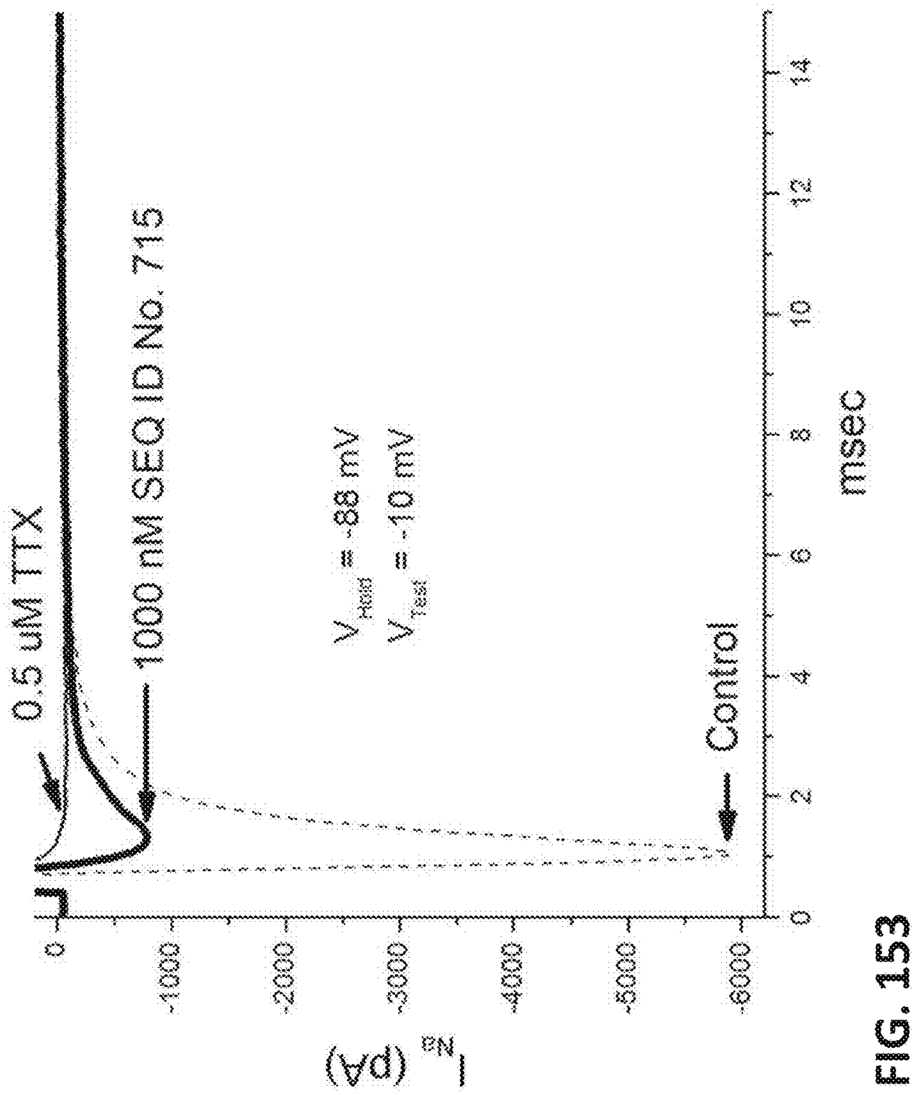

FIG. 153 shows the effect of Pra-[Nle6; Glu12,28]JzTx-V(1-29) (Seq ID No. 715) on TTX-sensitive Nav channels in C57 Black 6 mouse DRG neuron. Cell was held at −88 mV and peak inward Nav currents were measured at −10 mV. 'Control' trace shows Nav current before Seq ID No. 715, '1000 nM Seq ID No. 715' trace shows Nav current after Seq ID No. 715 addition, and '0.5 μM TTX' trace shows Nav current after TTX. Note that 1000 nM Pra-[Nle6; Glu12,28]JzTx-V(1-29) (Seq ID No. 715) blocks approximately 90% of TTX-sensitive Nav current.

Figure 154:
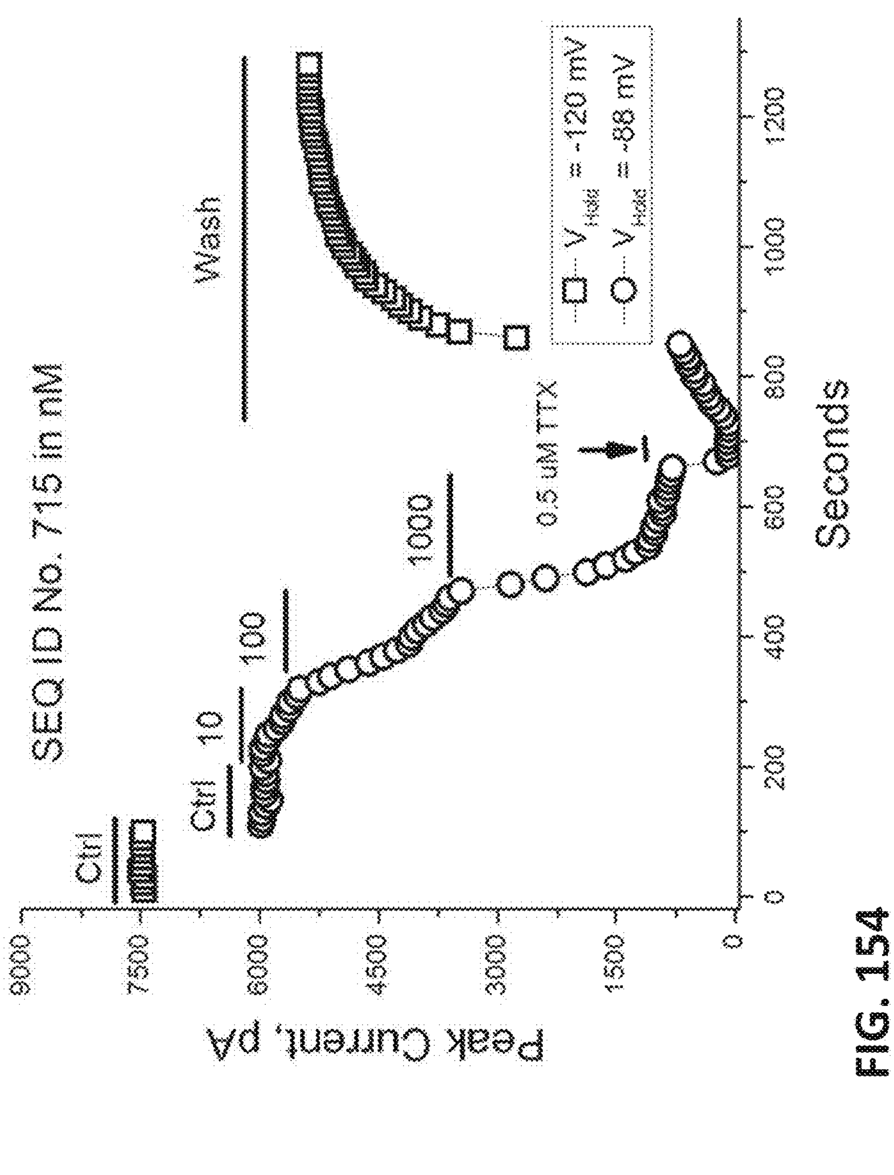

FIG. 154 shows the time course of increasing concentrations of Pra-[Nle6; Glu12,28]JzTx-V(1-29) (Seq ID No. 715) against TTX-sensitive Nav channels in C57 Black 6 mouse DRG neuron. Peak inward Nav currents were measured at −10 mV every 10 seconds in the presence of increasing concentrations of Seq ID No. 715; cell was held at either −120 mV (squares), a voltage where Nav channels are completely non-inactivated, or −88 mV (circles), a voltage that yields approximately 20% inactivation. 'Ctrl' indicates Nav current in the absence of Pra-[Nle6; Glu12,28]JzTx-V(1-29) (Seq ID No. 715), '0.5 μM TTX' indicates Nav current in the presence of 0.5 μM TTX, and 'Wash' indicates Nav current following removal of Pra-[Nle6; Glu12,28]JzTx-V(1-29) (Seq ID No. 715) and TTX.

Figure 155:
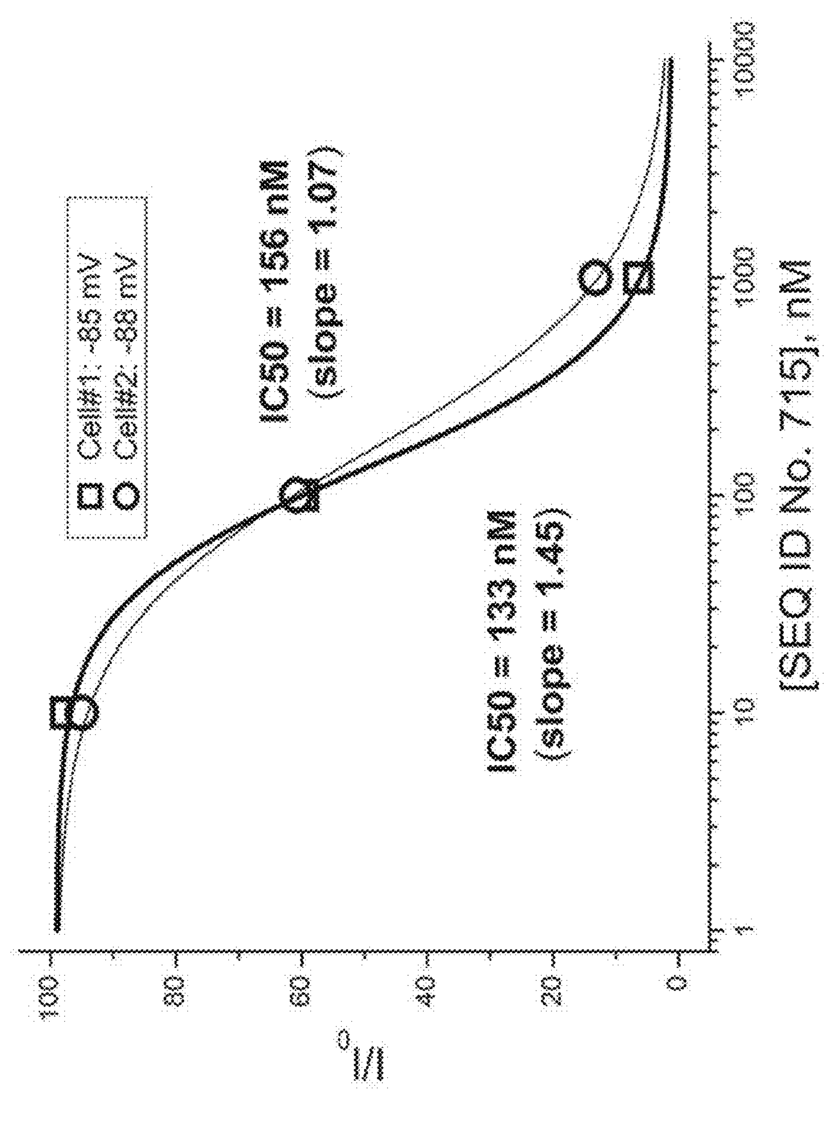

FIG. 155 shows the dose-response curves of Pra-[Nle6; Glu12,28]JzTx-V(1-29) (Seq ID No. 715) against TTX-sensitive Nav channels in two separate C57 Black 6 mouse DRG neurons. Peak inward Nav currents were measured at −10 mV in the presence of increasing concentrations of Pra-[Nle6; Glu12,28]JzTx-V(1-29) (Seq ID No. 715) and divided by current before Seq ID No. 715 addition ($I/I_0$); cells were held at a voltage that yielded approximately 20% inactivation.

Figure 156:
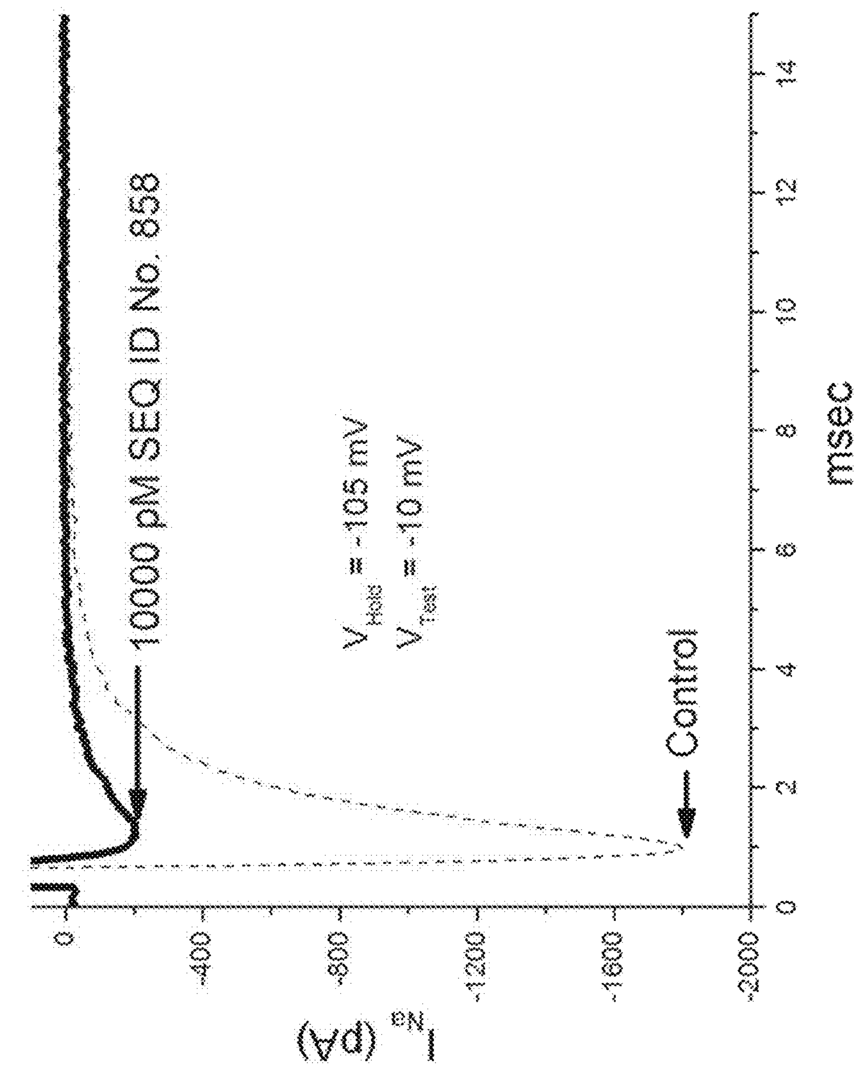

FIG. 156 shows the effect of Pra-[Nle6; 5-BrW24; Glu28]JzTx-V(1-29) (Seq ID No. 858) on human Nav1.7 Na channels expressed in HEK293 cells. Cell was held at −105 mV and peak inward Nav currents were measured at −10 mV. 'Control' trace shows Nav current before Seq ID No. 858, and '10000 pM (10 nM) Seq ID No. 858' trace shows Nav current after Pra-[Nle6; 5-BrW24; Glu28]JzTx-V(1-29) (Seq ID No. 858) addition. Note that 100 nM Pra-[Nle6; 5-BrW24; Glu28]JzTx-V(1-29) (Seq ID No. 858) blocks approximately 90% of Nav current.

Figure 157:
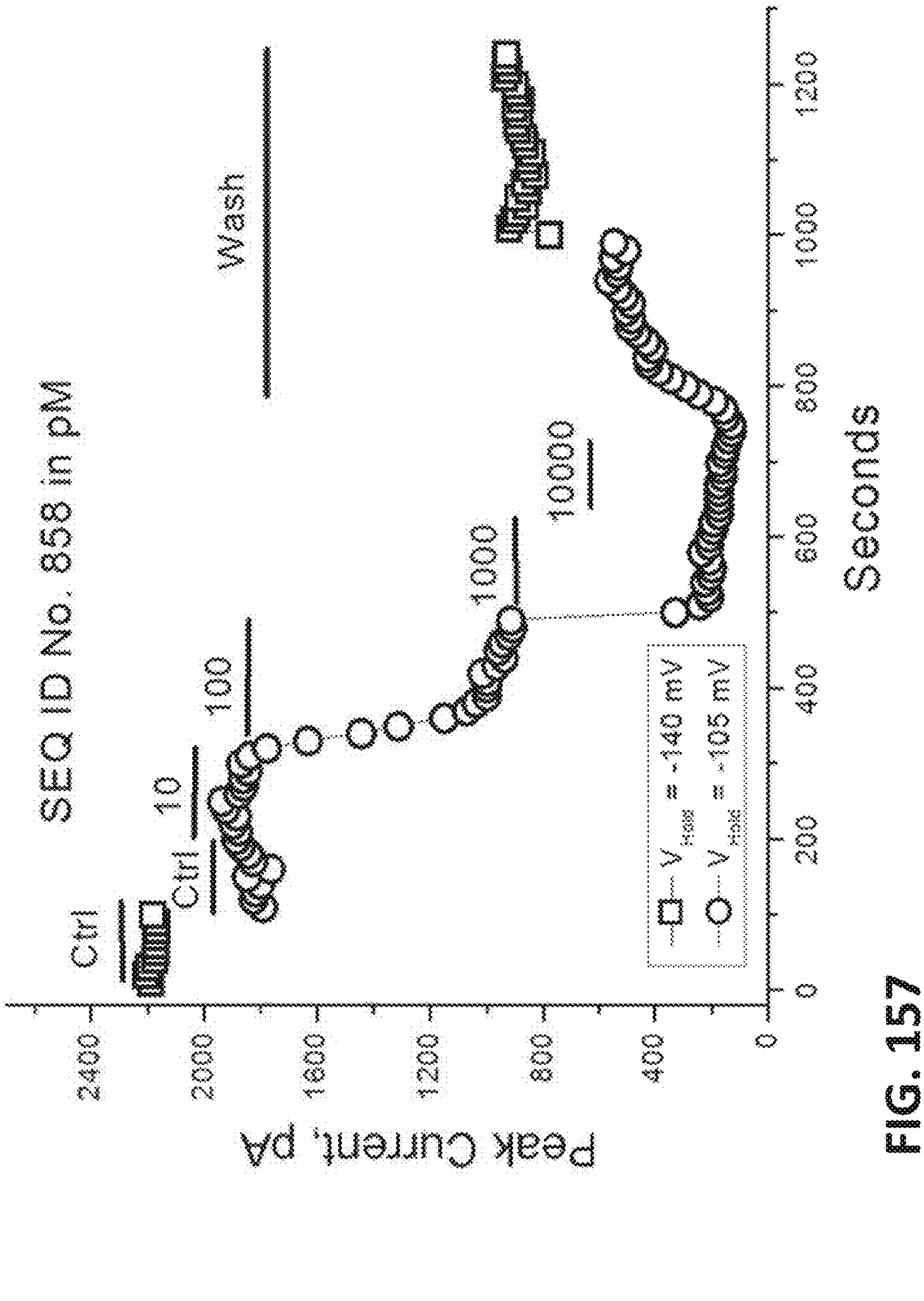

FIG. 157 shows the time course of increasing concentrations of Pra-[Nle6; 5-BrW24; Glu28]JzTx-V(1-29) (Seq ID No. 858) against human Nav1.7 Na channels expressed in HEK293 cells. Peak inward Nav currents were measured at −10 mV every 10 seconds in the presence of increasing concentrations of Pra-[Nle6; 5-BrW24; Glu28]JzTx-V(1-29) (Seq ID No. 858); cell was held at either −140 mV (squares), a voltage where Nav channels are completely non-inactivated, or −105 mV (circles), a voltage that yields approximately 20% inactivation. 'Ctrl' indicates Nav current in the absence of Pra-[Nle6; 5-BrW24; Glu28]JzTx-V(1-29) (Seq ID No. 858) and 'Wash' indicates Nav current following removal of Seq ID No. 858.

Figure 158:
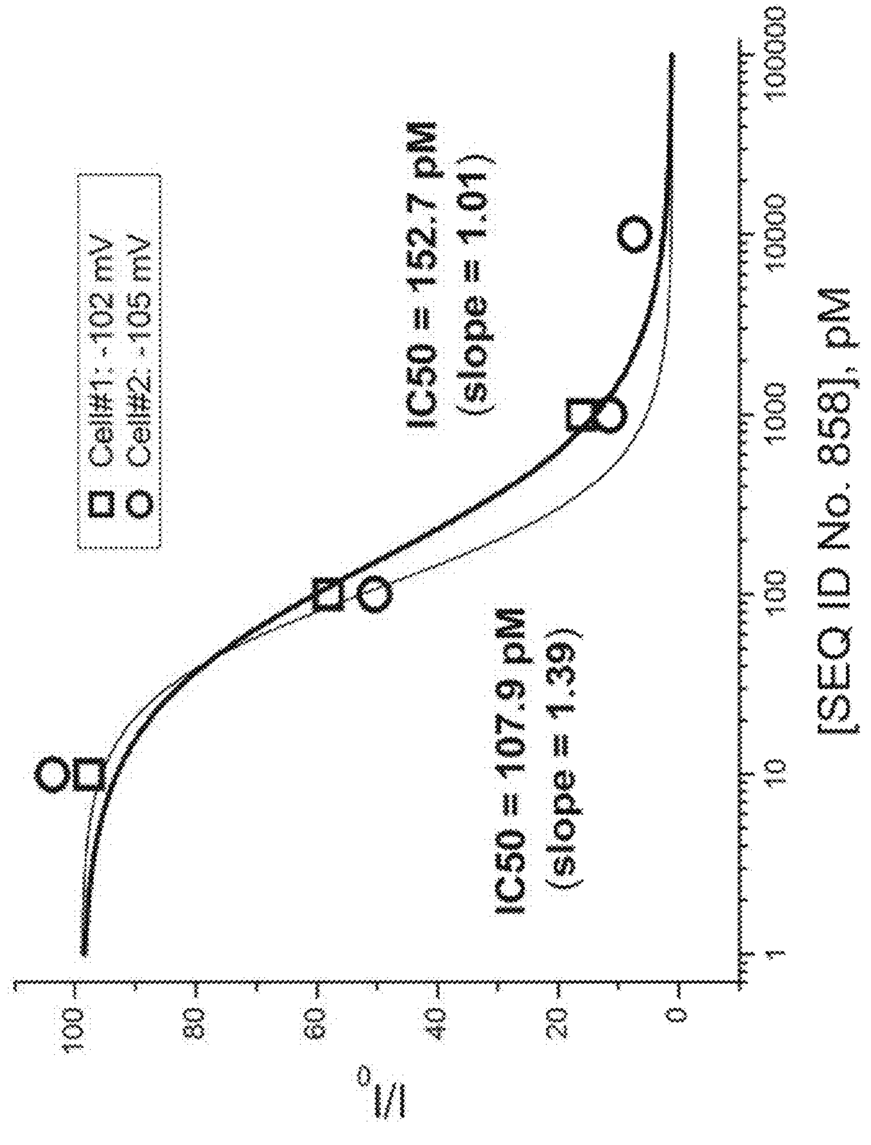

FIG. 158 shows the dose-response curves of Pra-[Nle6; 5-BrW24; Glu28]JzTx-V(1-29) (Seq ID No. 858) against human Nav1.7 Na channels in two separate HEK293 cells. Peak inward Nav currents were measured at −10 mV in the presence of increasing concentrations of Pra-[Nle6; 5-BrW24; Glu28]JzTx-V(1-29) (Seq ID No. 858) and divided by current before Seq ID No. 858 addition ($I/I_0$); cells were held at a voltage that yielded approximately 20% inactivation.

Figure 159:
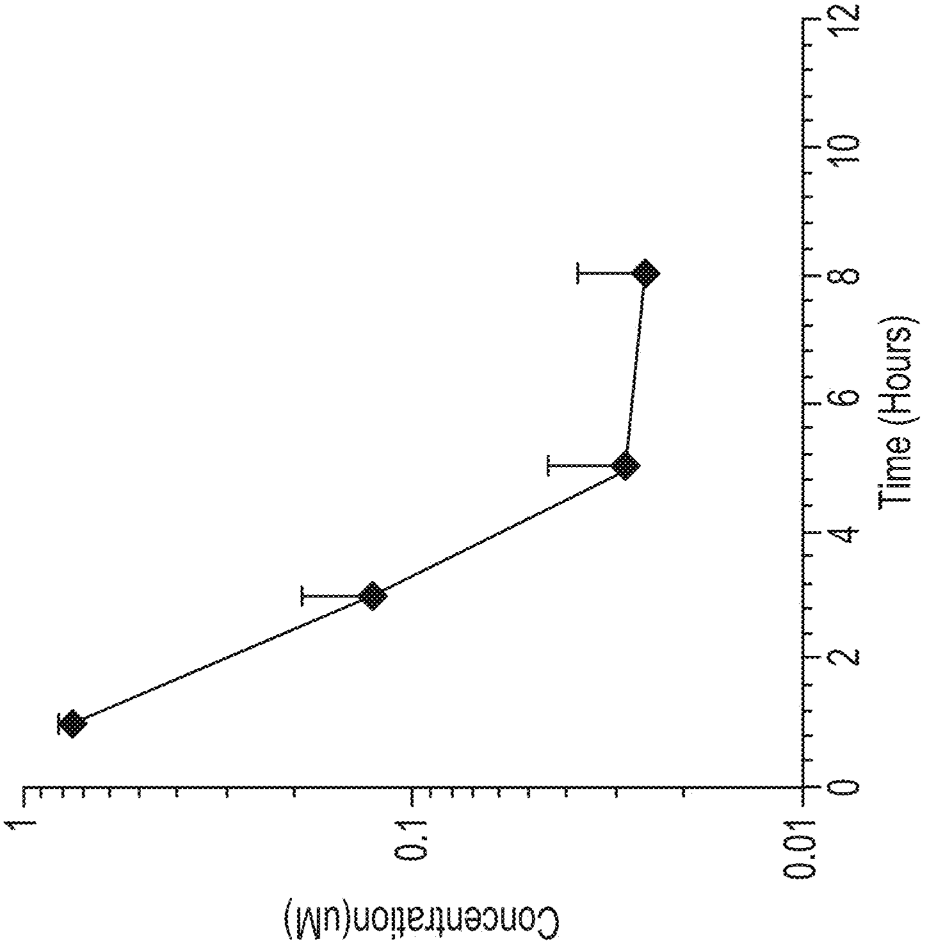

FIG. 159 shows the mean concentration—time profile of CyA-[Nle6,Pra17,Glu28]JzTx-V(1-29) (SEQ ID NO:395) in CD-1 male mouse following a subcutaneous dose at 2 mpk. CyA-[Nle6,Pra17,Glu28]JzTx-V(1-29) (SEQ ID NO:395) was rapidly absorbed with a mean Cmax of 0.73 μM observed at 1 h following a subcutaneous dose at 2 mg/kg. Mean Cmax concentration was 46-fold over the moue DRG Nav1.7 IC 50. The half-life of the peptide was approximately 2.3 hours.

Figure 160:
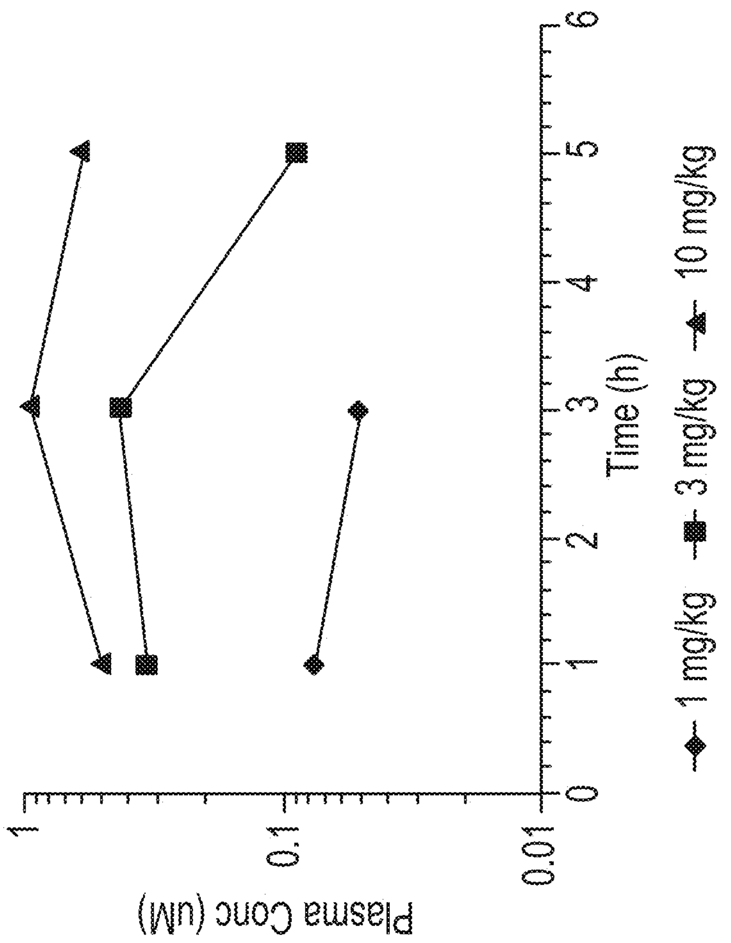

FIG. 160 shows the mean concentrations—time profiles of CyA-[Nle6,Pra17,Glu28]JzTx-V(1-29) (SEQ ID NO:395) in Male Sprague-Dawley rats following a subcutaneous dose at 1, 3 or 10 mg/kg. SEQ ID NO:395 was dose to rats at 1, 3 or 10 mg/kg by a single subcutaneous administration. All the doses were tolerated. Tmax was observed at 1, 3 and 3 hours with the corresponding mean Cmax values of 0.079, 0.43 and 0.97 μM for the 1, 3 and 10 mg/kg dose groups, respectively. The mean Cmax values were 56-, 306- and 684-fold over the rat DRG Nav1.7. T1/2 was not calculated due to the limited sampling scheme.

Figure 161:
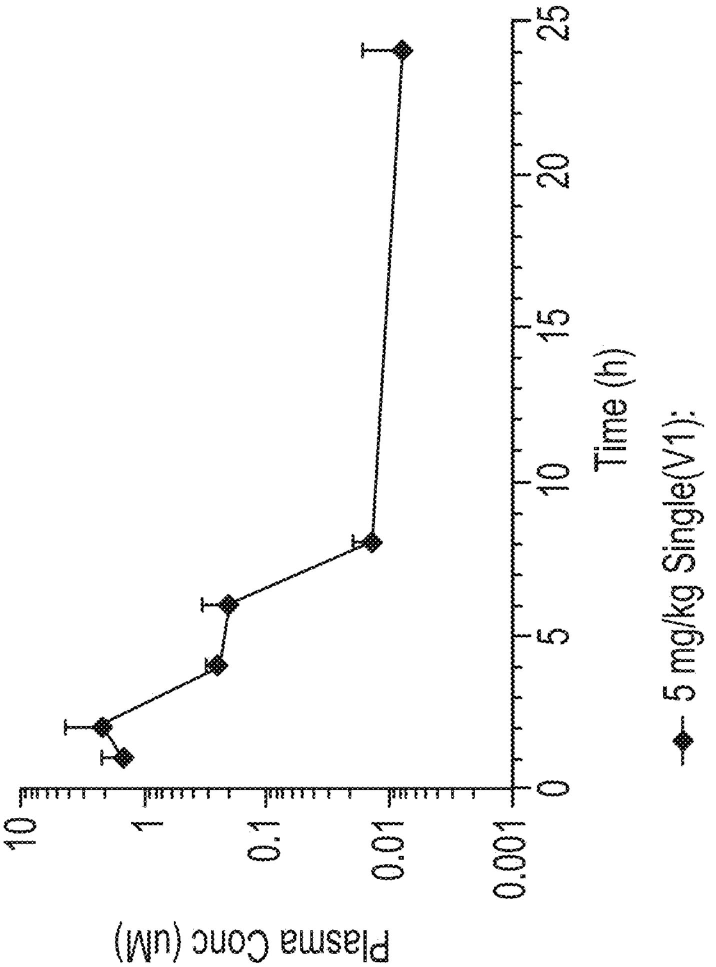

FIG. 161 shows the mean concentrations—time profiles of Pra-[Nle6; Glu28]JzTx-V(1-29) (SEQ ID NO:328) in Male CD-1 mice following a subcutaneous dose at 5 mg/kg. Pra-[Nle6; Glu28]JzTx-V(1-29) (SEQ ID NO:328) was absorbed slowly with a mean Cmax of 2.2 μM observed at 2 h following a subcutaneous dose at 5 mg/kg. Mean Cmax concentration was 196-fold over the moue DRG Nav1.7 IC 50. The half-life of the peptide was approximately 4.5 hours.

Figure 162:
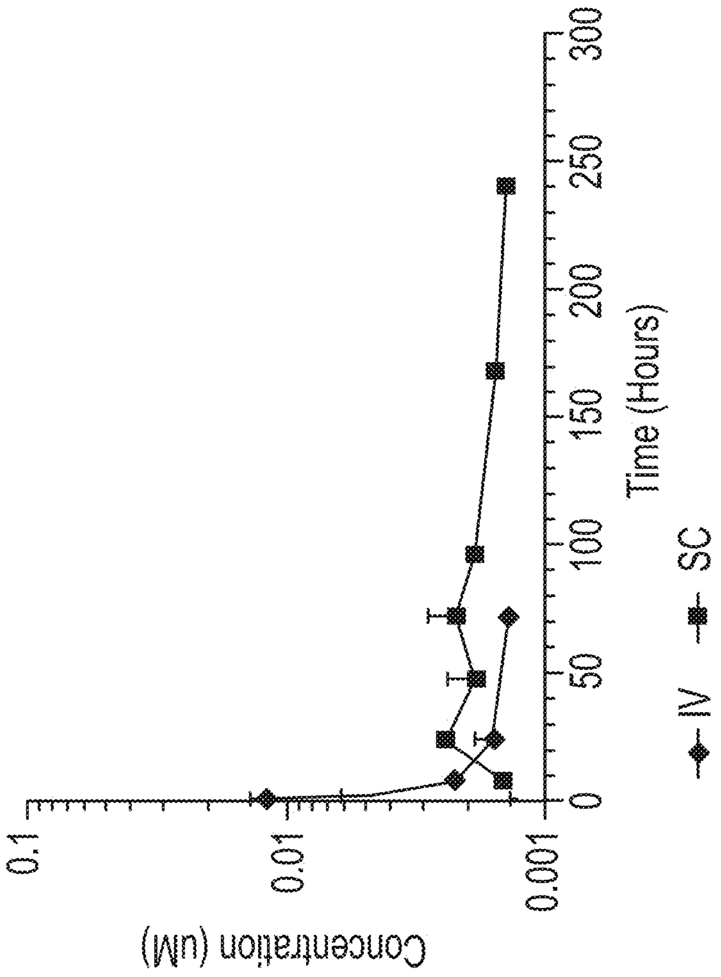

FIG. 162 shows the mean concentrations—time profiles of Immunoglobulin Peptide Conjugate 3 (see, Example 9, Table 21) in Male CD-1 mice following a single intravenous (IV) or subcutaneous (SC) dose at 5 mg/kg. The clearance (CL), volume of distribution at the steady state (Vdss) and half-life of Immunoglobulin Peptide Conjugate 3 following IV administration were 0.079 L/hr/kg, 12.3 L/hr and 113 hours, respectively. The absorption of 2945893 was complete (100%) following a single dose subcutaneous administration with Cmax observed at 24 hours post-dose with a mean concentration of 0.0025 μM.

Figure 163:
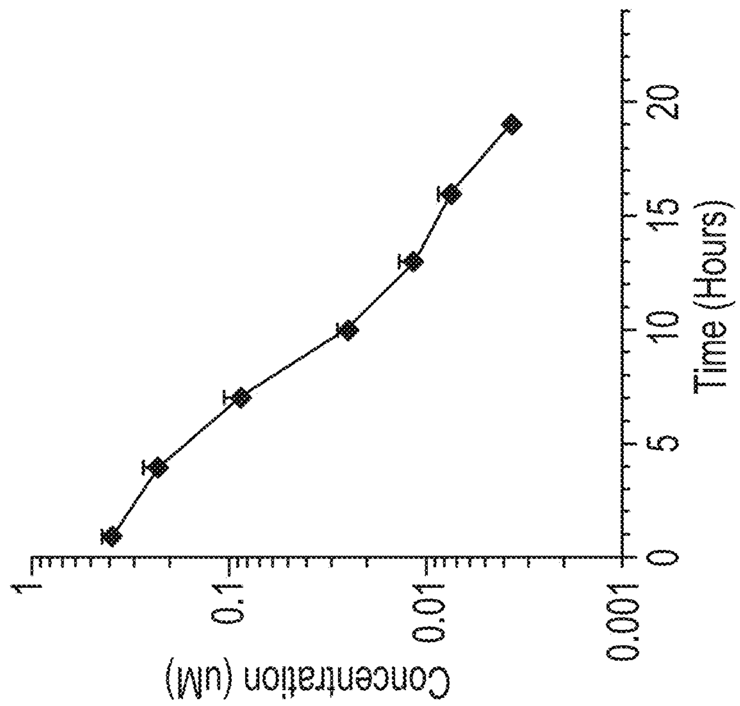

FIG. 163 shows the mean concentrations—time profiles of Immunoglobulin Peptide Conjugate 7 (see, Example 9, Table 21) in Male CD-1 mice following a single intravenous (IV) dose at 5 mg/kg. The clearance (CL), volume of distribution at the steady state (Vdss) and half-life of Immunoglobulin Peptide Conjugate 7 following IV administration to male CD-1 mice were 0.01 L/hr/kg, 0.25 L/hr and 27 hours, respectively.

Figure 164:
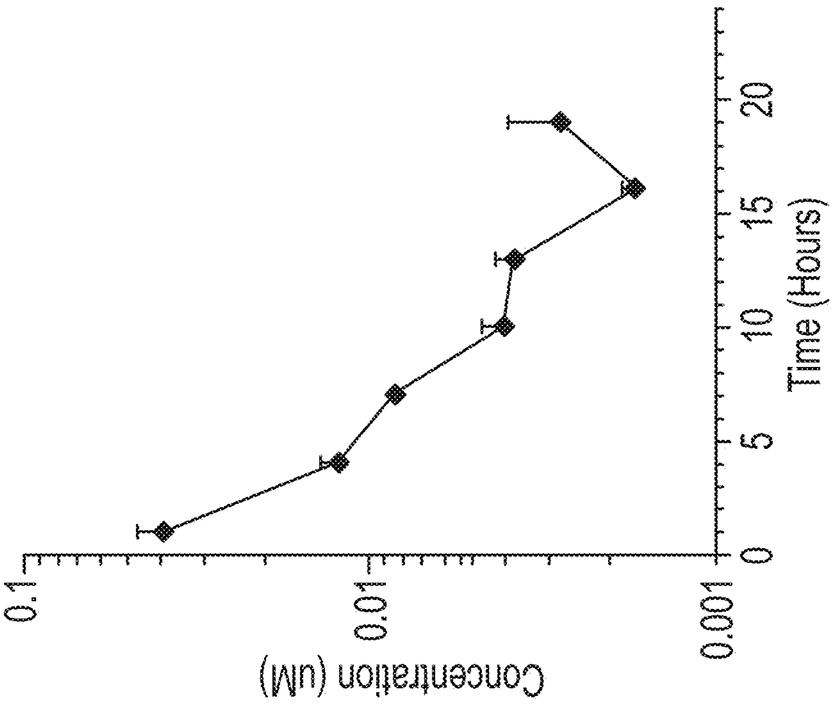

FIG. 164 shows the mean concentrations—time profiles of Immunoglobulin Peptide Conjugate 5 (see, Example 9, Table 21) in Male CD-1 mice following a single intravenous (IV) dose at 5 mg/kg. The clearance (CL), volume of distribution at the steady state (Vdss) and half-life of Immunoglobulin Peptide Conjugate 5 following IV administration to male CD-1 mice were 0.06 L/hr/kg, 3.14 L/hr and 38.4 hours, respectively.

Figure 165:
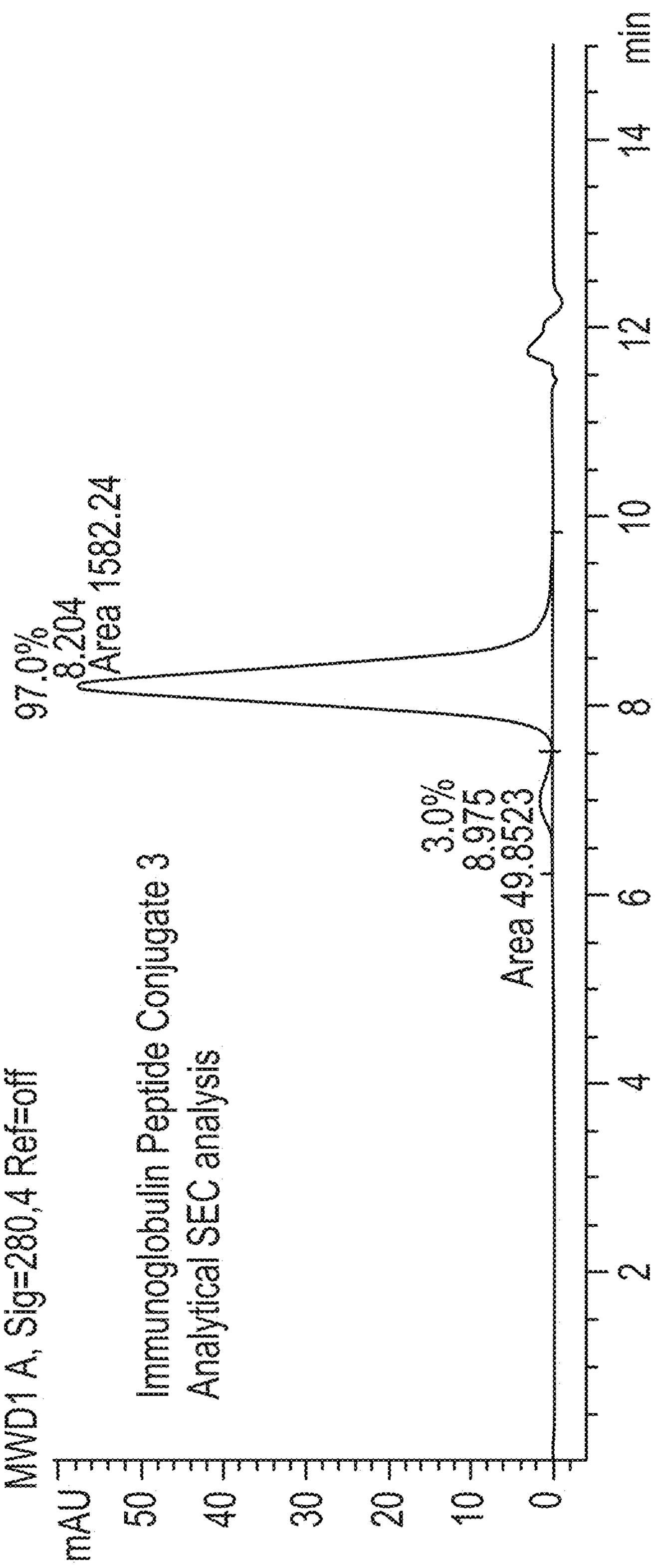

FIG. 165 shows the size exclusion chromatography (SEC) analysis (UV absorbance at 280 nM) of Immunoglobulin Peptide Conjugate 3 (see, Example 9, Table 21) prepared by the redox method. The desired conjugate has a purity of 96.95% by this method with 3.05% higher molecular weight species.

Figure 166A:
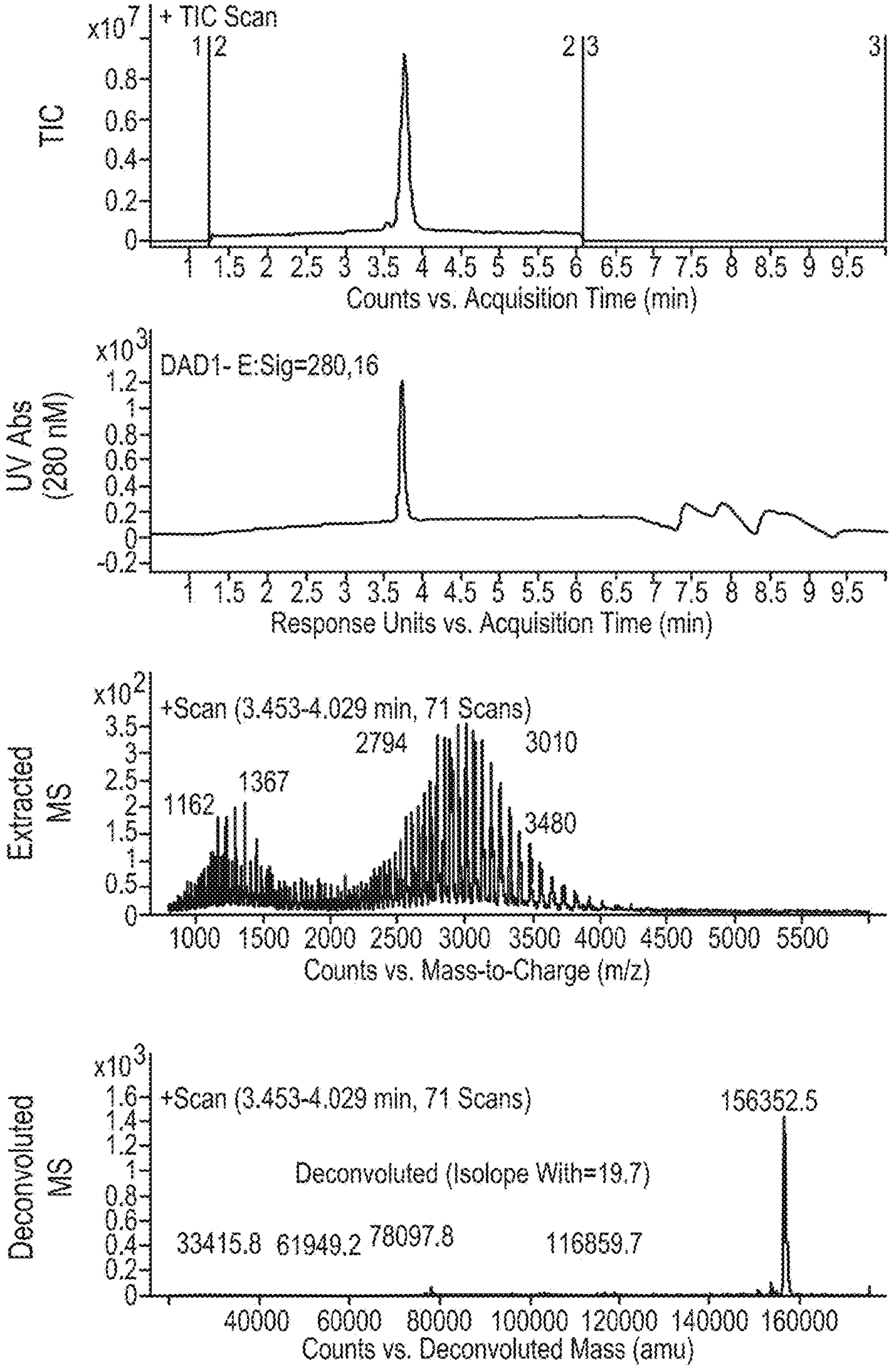
Figure 166B:
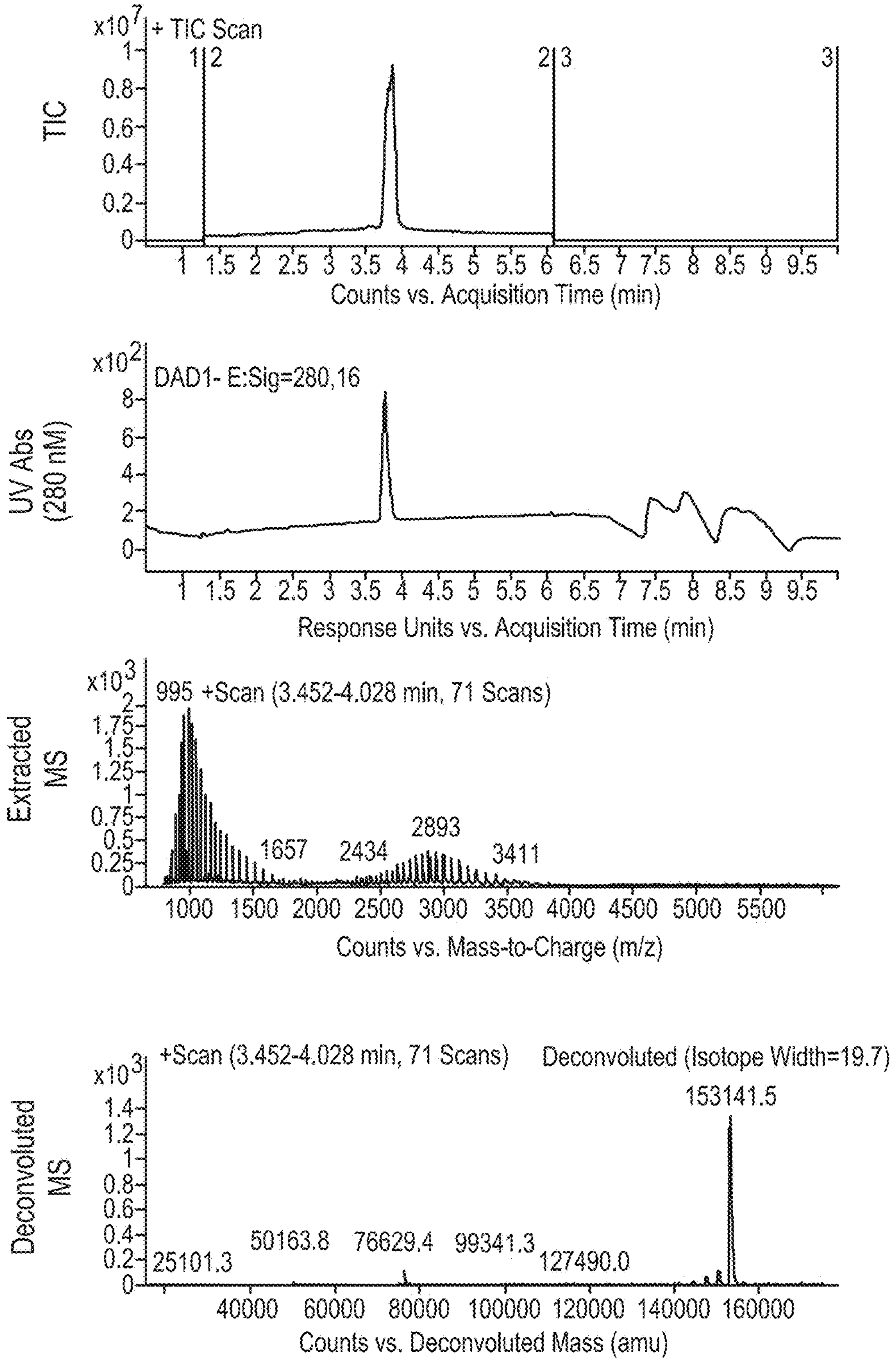
Figure 166C:
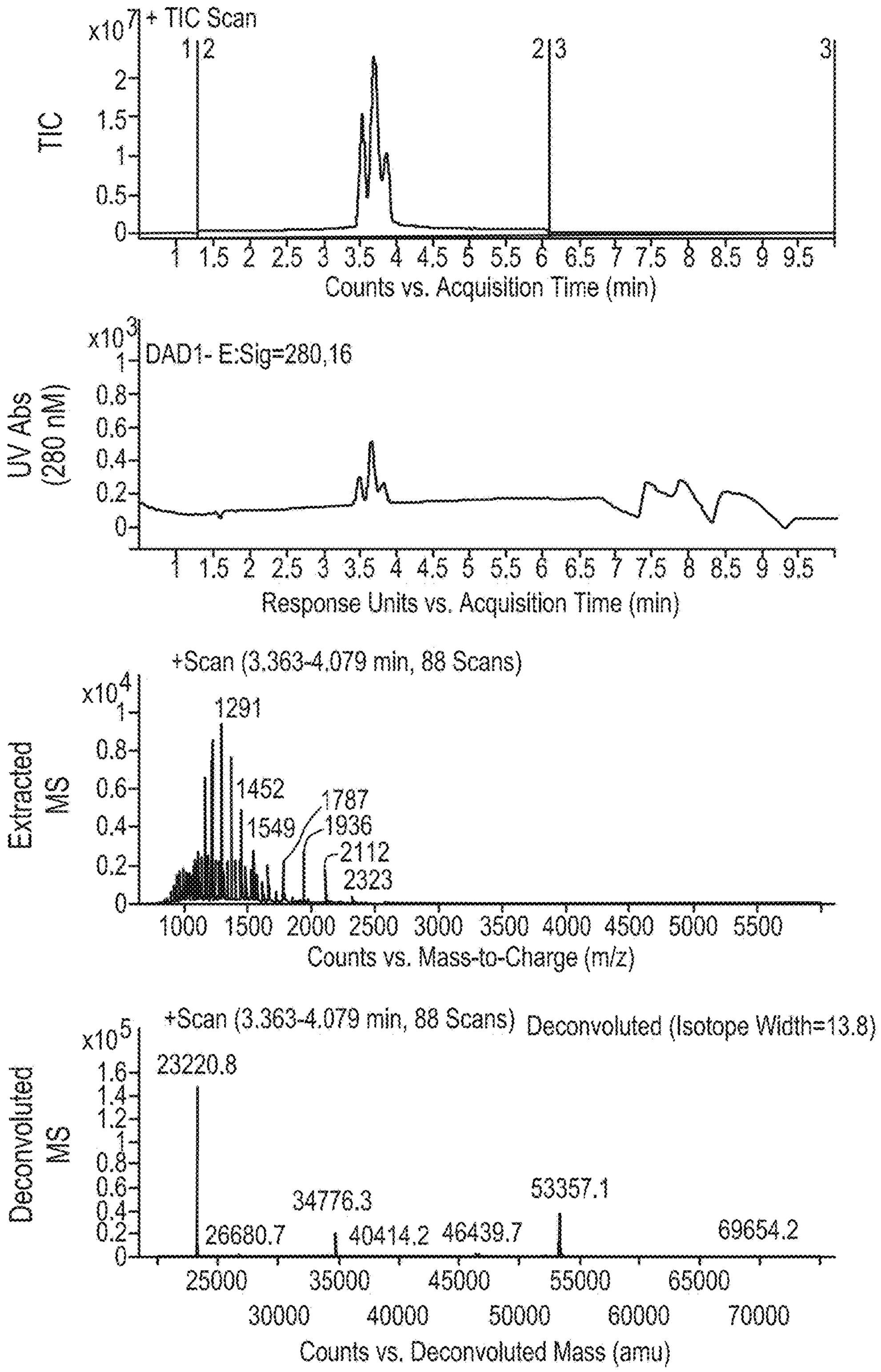

FIG. 166A-C shows LC/MS-TOF analysis of three different samples of Immunglobulin Peptide Conjugate 3 (see, Example 9, Table 21). FIG. 166A shows the data from intact sample (non-deglycosylated); FIG. 166B shows data from a deglycosylated sample; and FIG. 166C shows data from a deglycosylated and reduced sample. In FIG. 166A-C, the top row contains the total ion count (TIC) trace from the LC-MS-TOF. The second row displays the chromatogram (UV absorbance at 280 nM). The third row shows the charge envelope of the extracted MS spectrum from the major peak in the TIC trace. The bottom row is the deconvoluted mass spectrum resulting from the extracted MS spectrum. The deconvoluted mass of the intact sample was 156352.5 Da, which is consistent with the conjugation of two peptide-linker constructs. The deconvoluted mass of the deglycosylated sample was 153141.5 Da after loss of the sugar(s). The deconvoluted masses observed for the deglycosylated and reduced sample were 23220.8 Da and 53357.1 Da, corresponding to the IgG light chain and IgG heavy with a conjugated peptide-linker construct, respectively. The deconvoluted mass of 34776.3 Da corresponds to the PNGase enzyme in the sample.

Figure 167:
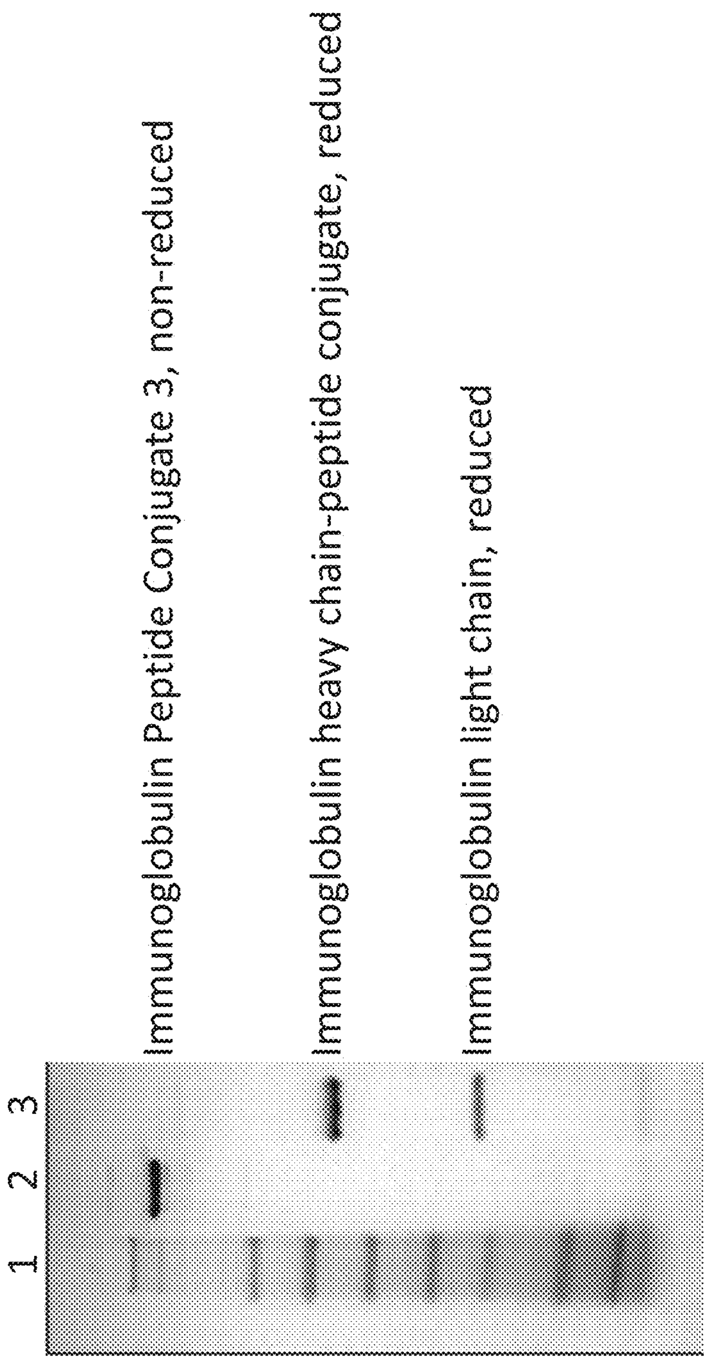

FIG. 167 shows the SDS-PAGE gel electrophoresis analysis of the non-reduced (lane 2) and reduced (lane 3) samples of Immunoglobulin Peptide Conjugate 3 (see, Example 9, Table 21) with the standard MW ladder (lane 1). The upper band in lane 3 corresponds to the IgG heavy chain conjugated to the peptide-linker, and the lower band corresponds to the IgG light chain.

Figure 168A:
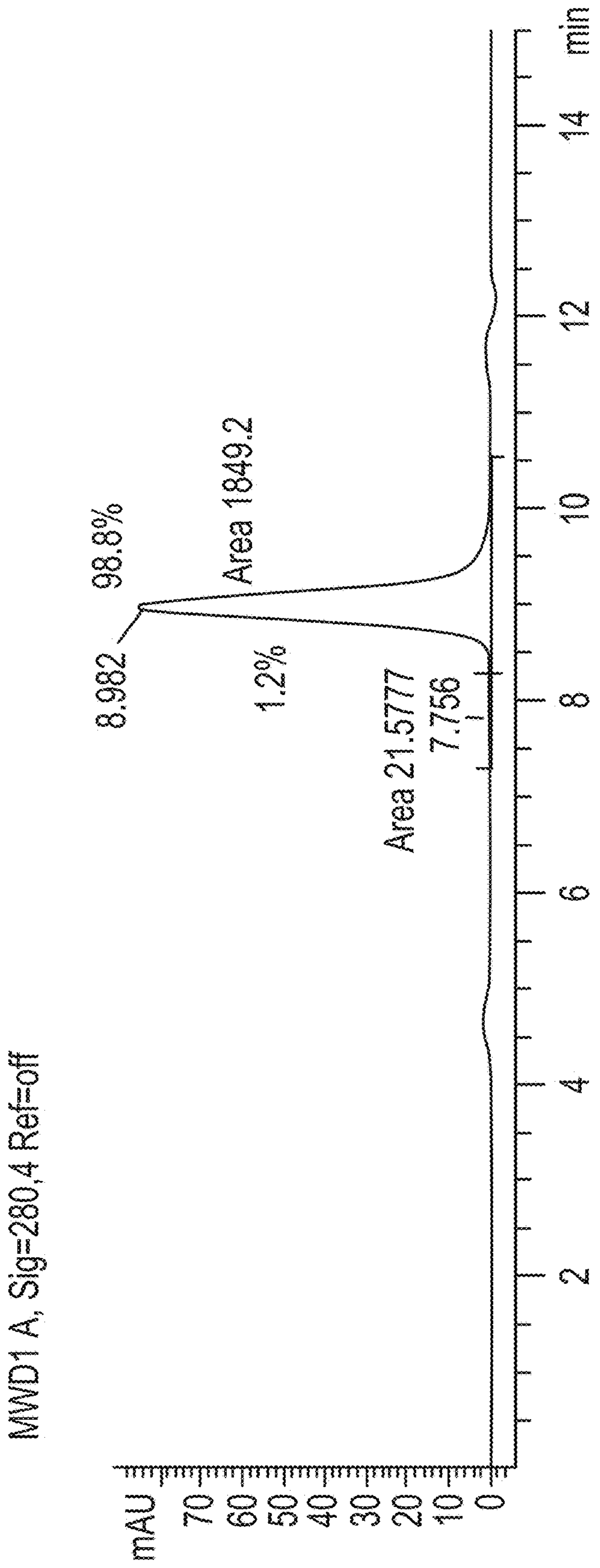
Figure 168B:
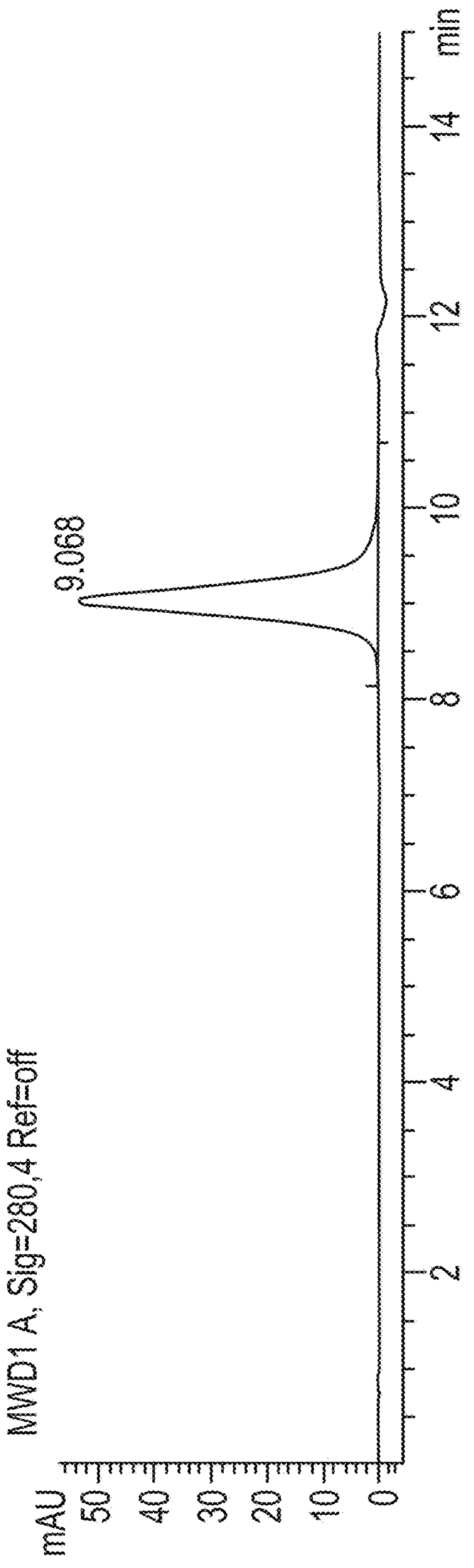

FIG. 168A-B shows the size exclusion chromatography (SEC) analysis (UV absorbance at 280 nM) of HSA-Peptide Conjugates 1 (FIG. 168A) and 2 (FIG. 168B). HSA-Peptide Conjugate 1 (see, Table 23) has a purity of 98.8% by this method with 1.2% higher molecular weight species, and HSA-Peptide Conjugate 2 (see, Table 23) has a purity of >99% by this method.

Figure 169A:
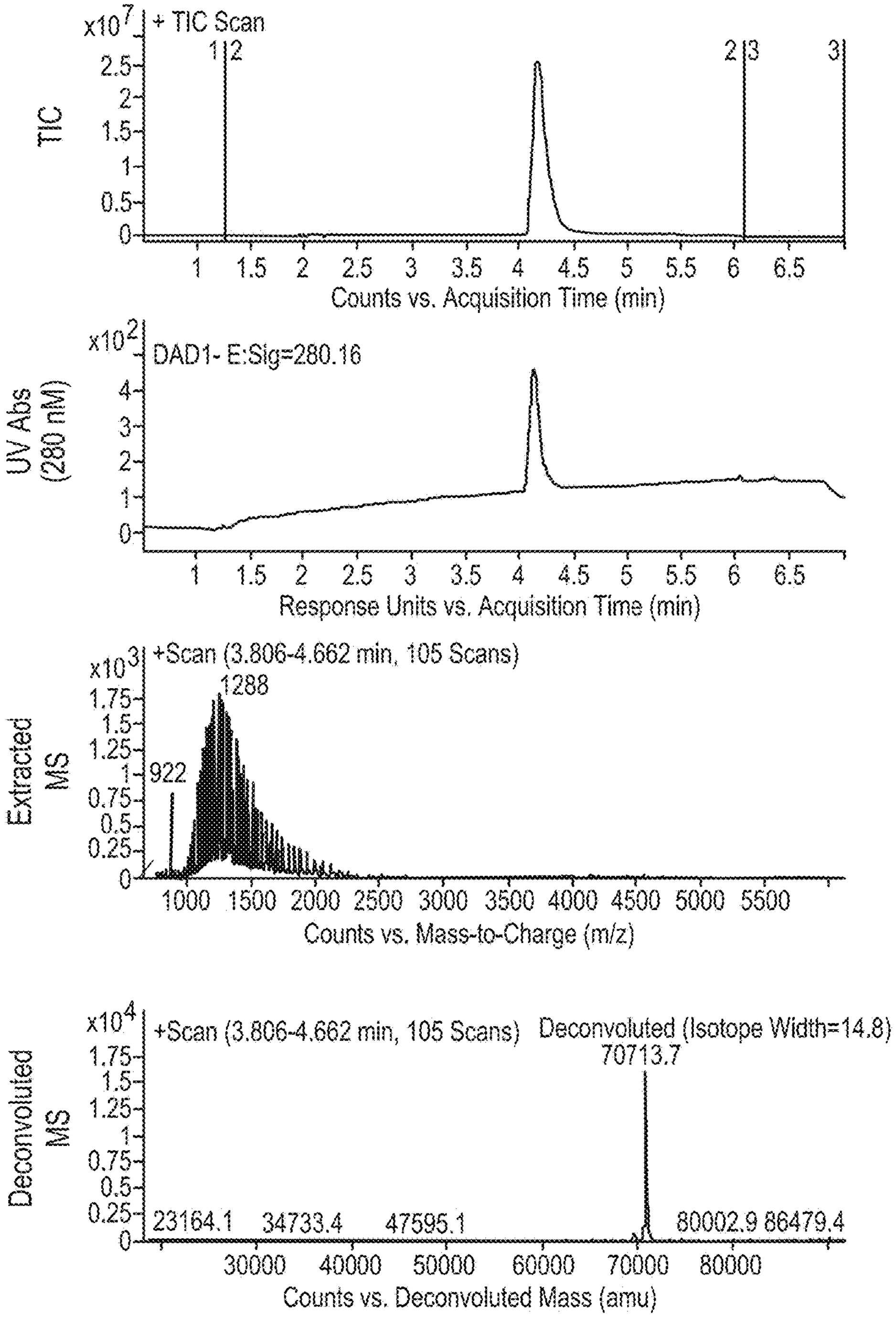
Figure 169B:
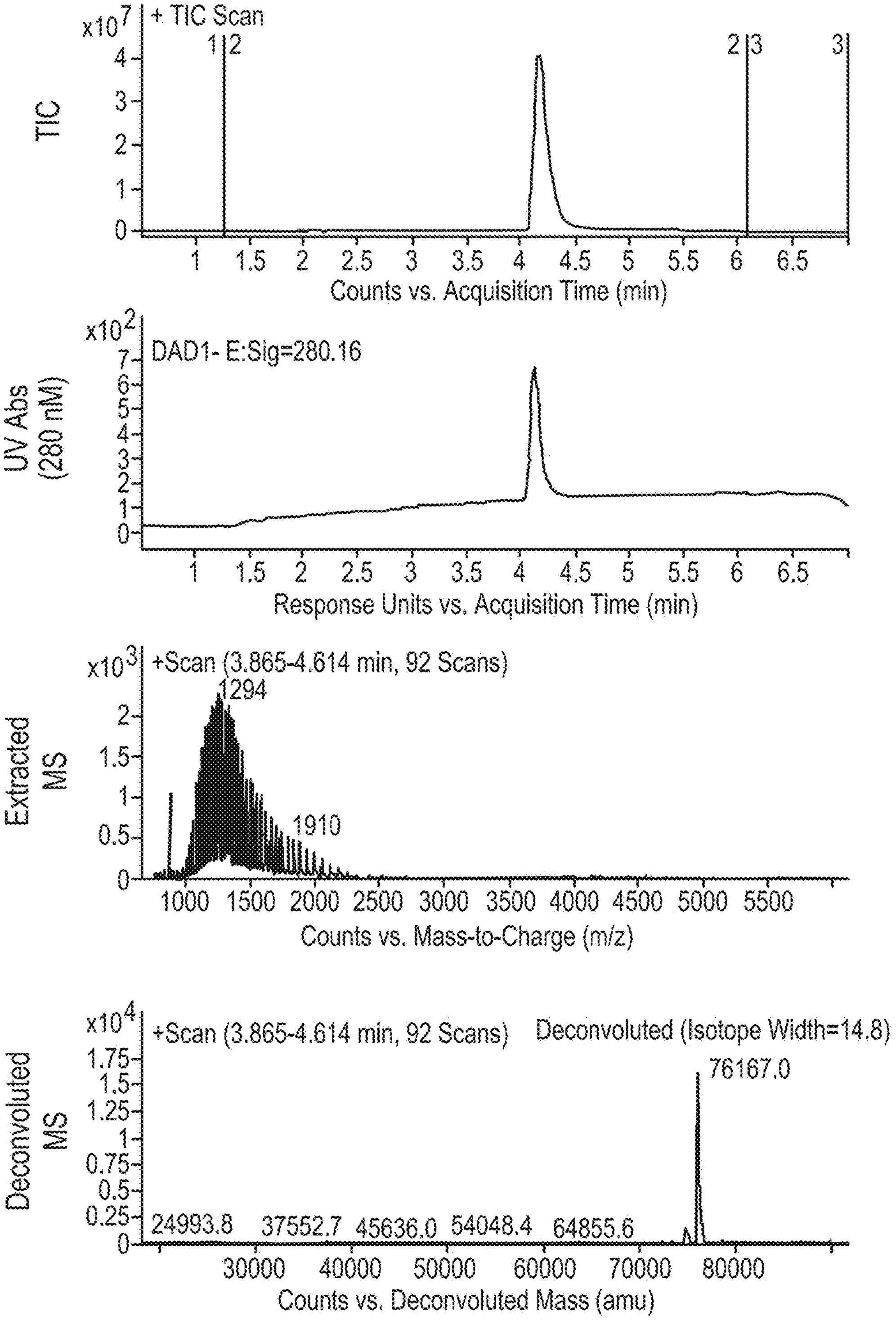

FIG. 169A-B shows the LC/MS-TOF analysis of HSA-Peptide Conjugates 1 (FIG. 169A) and 2 (FIG. 169B) (see, Table 23). The top row contains the total ion count (TIC) trace from the LC-MS-TOF. The second row displays the chromatogram (UV absorbance at 280 nM). The third row shows the charge envelope of the extracted MS spectrum from the major peak in the TIC trace. The bottom row is the deconvoluted mass spectrum resulting from the extracted MS spectrum. The deconvoluted mass of HSA-Peptide Conjugate 1 was 70713.7 Da, which is consistent with the conjugation of one peptide-linker construct. The deconvoluted mass of HSA-Peptide Conjugate 2 was 76167.0 Da, which is consistent with the conjugation of the dimeric peptide-linker construct.

Figure 170:
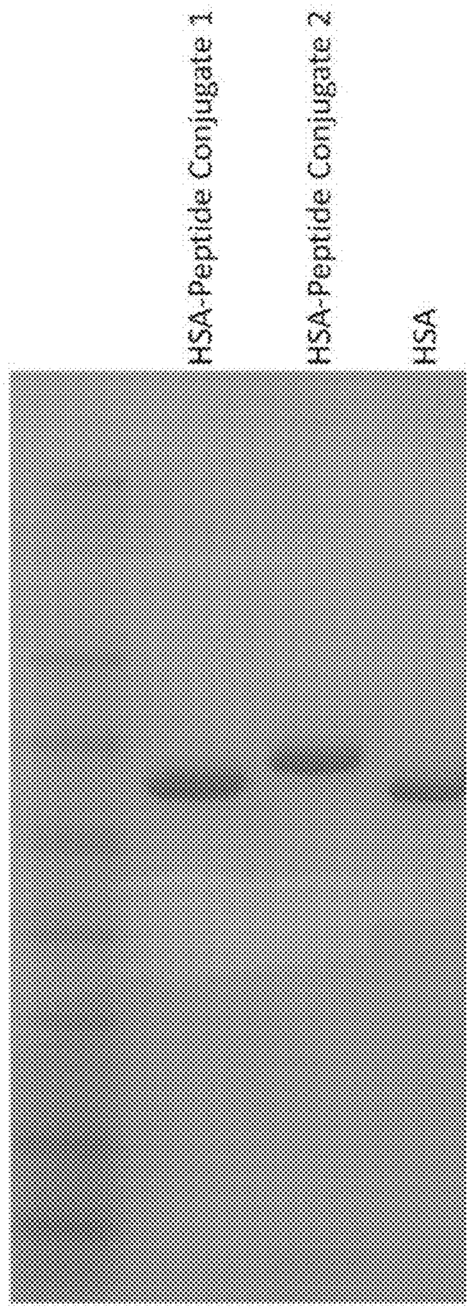

FIG. 170 shows the SDS-PAGE gel electrophoresis analysis of the HSA-Peptide Conjugates 1 (lane 2) and 2 (lane 3), HSA (lane 4) with the standard MW ladder (lane 1). The slight difference in the migration of the bands results from the conjugation of the monomeric or dimeric peptide-linker construct.

Figure 171:
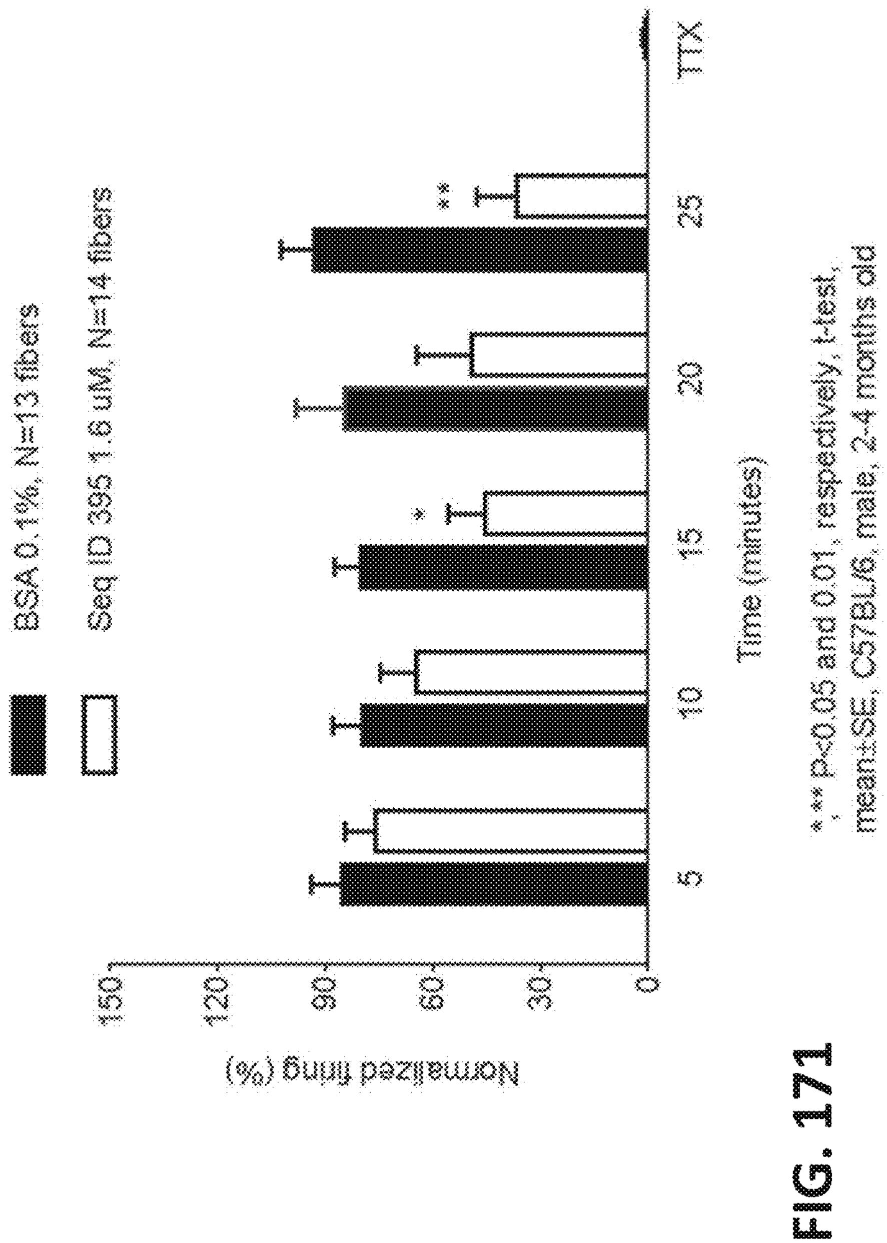

FIG. 171 shows the frequency of mechanically-evoked action potential firing in mouse saphenous nerve C-fibers following 1.6 μM CyA-[Nle6,Pra17,Glu28]JzTx-V(1-29) (SEQ ID NO:395) or 0.1% BSA as a negative control. Responses to 150 mN mechanical stimuli were significantly reduced 15 min and 25 min post-SEQ ID NO:395 application to the corium (dermis) side of the skin. TTX (1 μM) was applied at the end of the experiment and completely blocked action potential firing.

Figure 172:
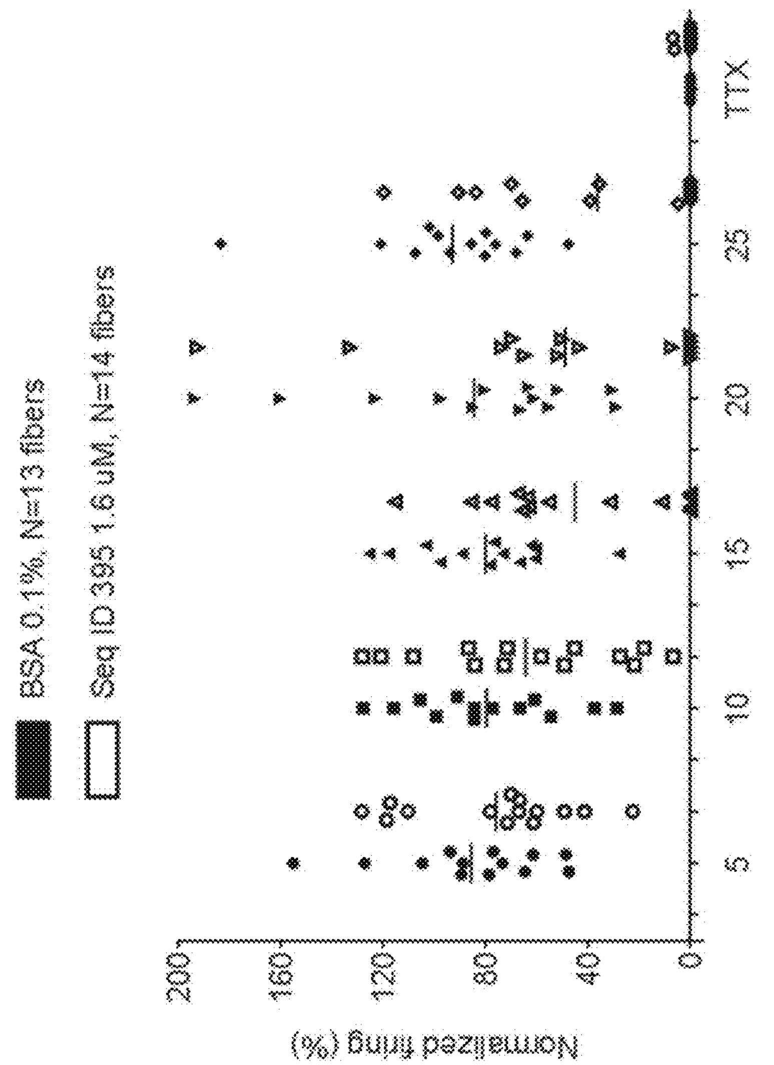

FIG. 172 shows the frequency of 150 nM mechanically-evoked action potential firing in mouse saphenous nerve C-fibers following 1.6 μM CyA-[Nle6,Pra17,Glu28]JzTx-V (1-29) (SEQ ID NO:395) or 0.1% BSA as a negative control. TTX (1 μM) was applied at the end of the experiment and completely blocked action potential firing. Responses from individual fibers are plotted showing that some C-fibers are completely blocked whereas other C-fibers are nominally blocked by 1.6 μM CyA-[Nle6,Pra17,Glu28]JzTx-V(1-29) (SEQ ID NO:395).

Figure 173:
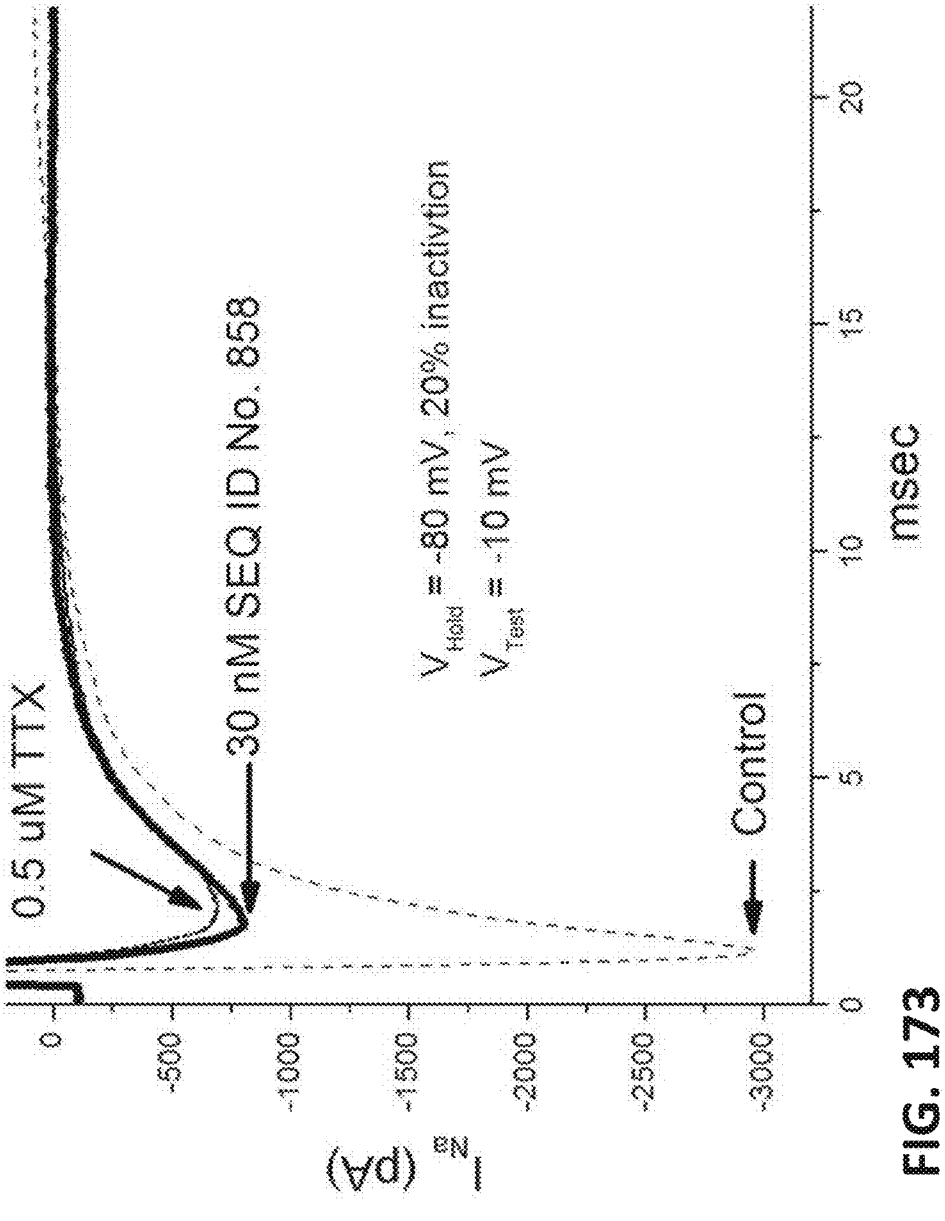

FIG. 173 shows the effect of Pra-[Nle6; 5-BrW24; Glu28] JzTx-V(1-29) (Seq ID No: 858) on TTX-sensitive Nav channels in C57 Black 6 mouse DRG neuron. Cell was held at −80 mV and peak inward Nav currents were measured at −10 mV. 'Control' trace shows Nav current before Pra-[Nle6; 5-BrW24; Glu28]JzTx-V(1-29) (Seq ID No: 858), '30 nM Seq ID No. 858' trace shows Nav current after Pra-[Nle6; 5-BrW24; Glu28]JzTx-V(1-29) (Seq ID No: 858) addition, and '0.5 μM TTX' trace shows Nav current after TTX. Note that 30 nM Pra-[Nle6; 5-BrW24; Glu28] JzTx-V(1-29) (Seq ID No: 858) blocks most of TTX-sensitive Nav current.

Figure 174:
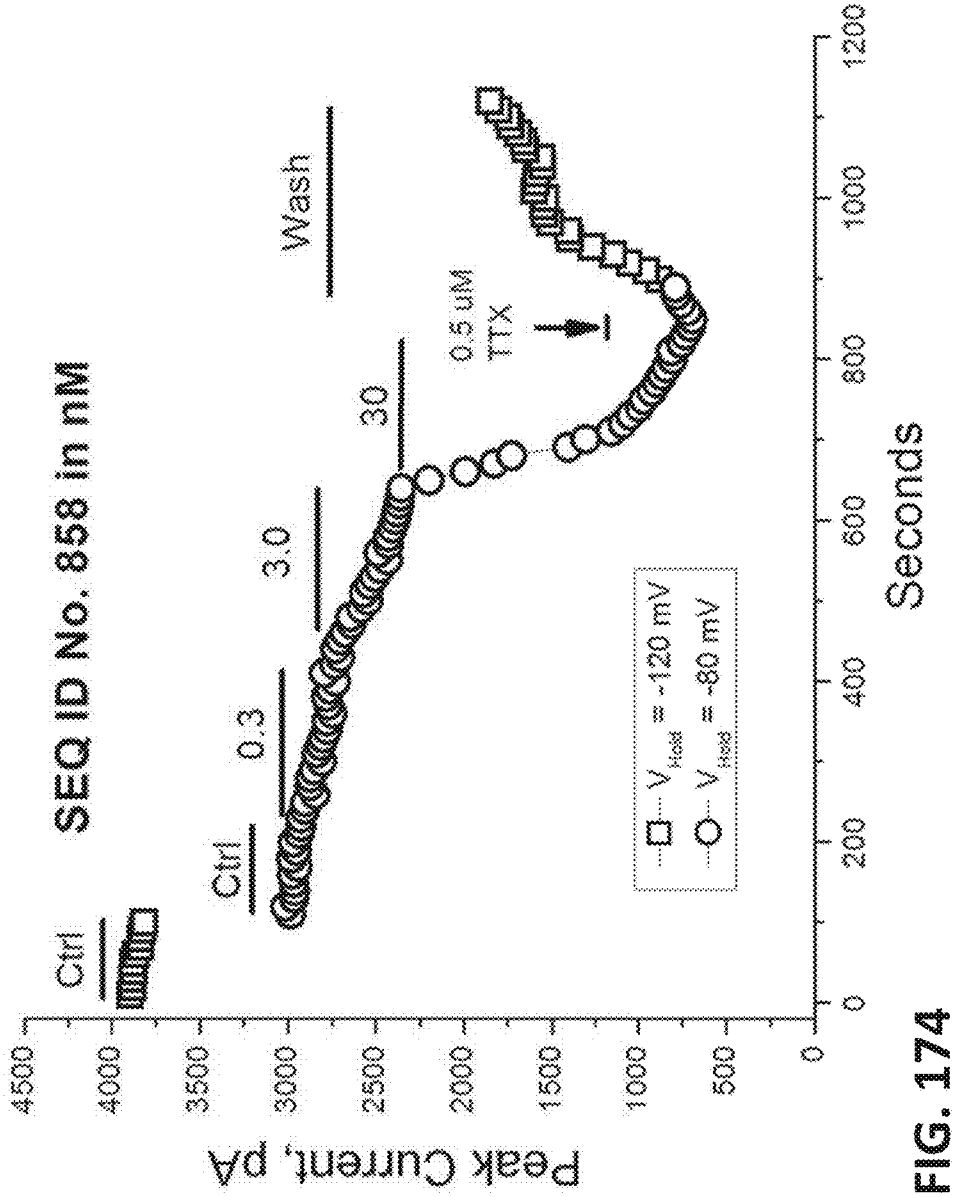

FIG. 174 shows the time course of increasing concentrations of Pra-[Nle6; 5-BrW24; Glu28]JzTx-V(1-29) (Seq ID No: 858) against TTX-sensitive Nav channels in C57 Black 6 mouse DRG neuron. Peak inward Nav currents were measured at −10 mV every 10 seconds in the presence of increasing concentrations of Pra-[Nle6; 5-BrW24; Glu28] JzTx-V(1-29) (Seq ID No: 858); cell was held at either −120 mV (squares), a voltage where Nav channels are completely non-inactivated, or −80 mV (circles), a voltage that yields approximately 20% inactivation. 'Ctrl' indicates Nav current in the absence of Pra-[Nle6; 5-BrW24; Glu28]JzTx-V(1-29) (Seq ID No: 858), '0.5 μM TTX' indicates Nav current in the presence of 0.5 μM TTX, and 'Wash' indicates Nav current following removal of Seq ID No. 858 and TTX.

Figure 175:
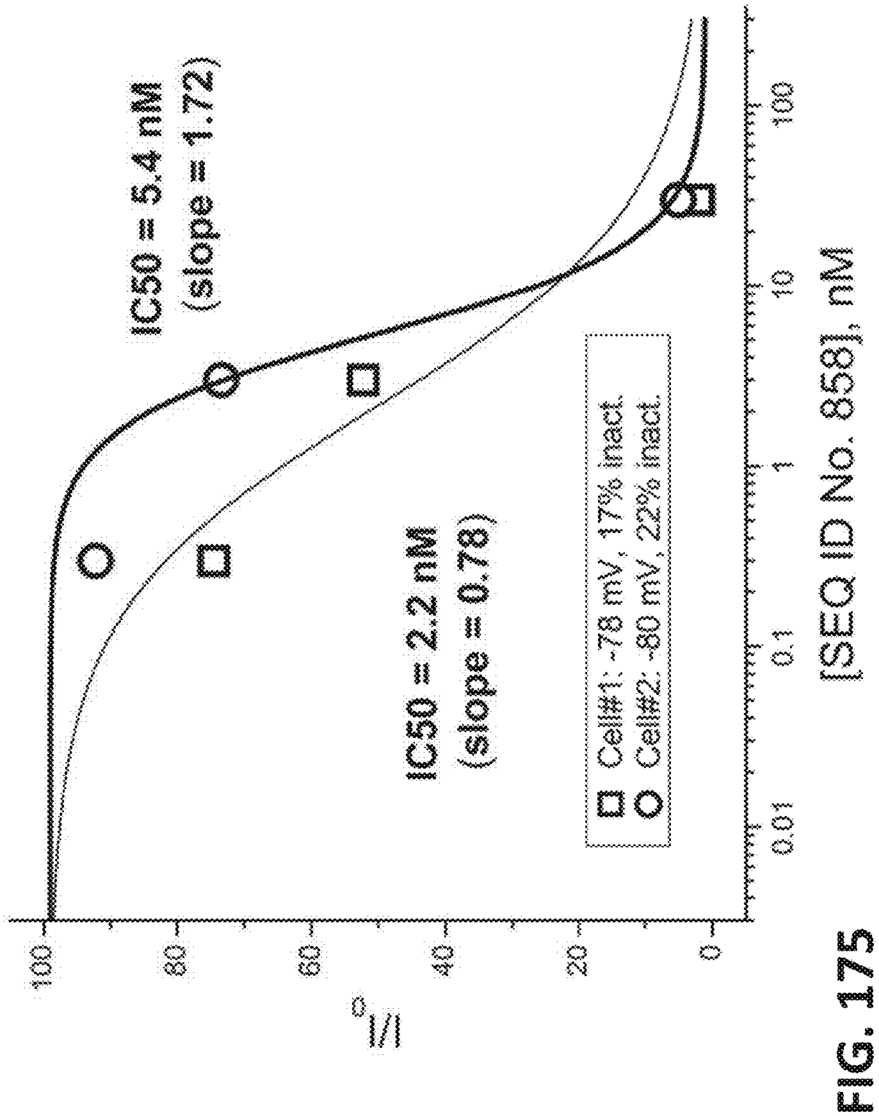

FIG. 175 shows the dose-response curves of Pra-[Nle6; 5-BrW24; Glu28]JzTx-V(1-29) (Seq ID No: 858) against TTX-sensitive Nav channels in two separate C57 Black 6 mouse DRG neurons. Peak inward Nav currents were measured at −10 mV in the presence of increasing concentrations of Pra-[Nle6; 5-BrW24; Glu28]JzTx-V(1-29) (Seq ID No: 858) and divided by current before the peptide addition (I/I0); cells were held at a voltage that yielded approximately 20% inactivation.

DETAILED DESCRIPTION OF EMBODIMENTS

The section headings used herein are for organizational purposes only and are not to be construed as limiting the subject matter described.

Definitions

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular. Thus, as used in this specification and the appended claims, the singular forms "a", "an" and "the" include plural referents unless the context clearly indicates otherwise. For example, reference to "a protein" includes a plurality of proteins; reference to "a cell" includes populations of a plurality of cells.

"Polypeptide" and "protein" are used interchangeably herein and include a molecular chain of two or more amino acids linked covalently through peptide bonds. The terms do not refer to a specific length of the product. Thus, "peptides," and "oligopeptides," are included within the definition of polypeptide. The terms include post-translational modifications of the polypeptide, for example, glycosylations, acetylations, biotinylations, 4-pentynoylations, PEGylations, phosphorylations and the like. In addition, protein fragments, analogs, mutated or variant proteins, fusion proteins and the like are included within the meaning of polypeptide. The terms also include molecules in which one or more amino acid analogs or non-canonical or unnatural amino acids are included as can be expressed recombinantly using known protein engineering techniques. In addition, fusion proteins can be derivatized as described herein by well-known organic chemistry techniques.

A composition of the present invention that includes a peptide or polypeptide of the invention covalently linked, attached, or bound, either directly or indirectly through a linker moiety, to another peptide or polypeptide of the invention or to a half-life extending moiety is a "conjugate" or "conjugated" molecule, whether conjugated by chemical means (e.g., post-translationally or post-synthetically) or by recombinant fusion.

"Biotin" is a water-soluble B-complex vitamin, i.e., vitamin B7, that is composed of an ureido (tetrahydroimidizalone) ring fused with a tetrahydrothiophene ring (See, Formula I).

Formula I

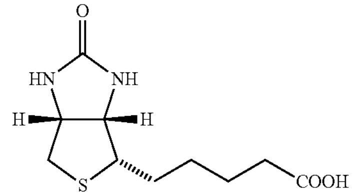

A valeric acid substituent is attached to one of the carbon atoms of the tetrahydrothiophene ring. In nature, biotin is a coenzyme in the metabolism of fatty acids and leucine, and it plays a role in vivo in gluconeogenesis. Biotin binds very tightly to the tetrameric protein avidin (e.g., Chicken avidin, bacterial streptavidin, and neutravidin), with a dissociation equilibrium constant $K_D$ in the order of $10^{-14}$ M to $10^{-16}$ M, which is one of the strongest known protein-ligand interactions, approaching the covalent bond in strength. (Laitinen et al. *Genetically engineered avidins and streptavidins*, Cell Mol Life Sci. 63 (24): 2992-30177 (2006)). The biotin-avidin non-covalent interaction is often used in different biotechnological applications. (See, Laitinen et al., *Genetically engineered avidins and streptavidins*, Cell Mol Life Sci. 63 (24): 2992-30177 (2006)).

"Biotinylated" means that a substance is covalently conjugated to one or more biotin moieties. Biotinylated peptides useful in practicing the invention can be purchased commercially (e.g., Midwest Bio-Tech Inc.) or can be readily synthesized and biotinylated. Biotinylation of compounds, such as peptides, can be by any known chemical technique. These include primary amine biotinylation, sulfhydryl biotinylation, and carboxyl biotinylation. For example, amine groups on the peptide, which are present as lysine side chain epsilon-amines and N-terminal α-amines, are common targets for primary amine biotinylation. Amine-reactive biotinylation reagents can be divided into two groups based on water solubility.

1) N-hydroxysuccinimide (NHS)-esters of biotin have poor solubility in aqueous solutions. For reactions in aqueous solution, they must first be dissolved in an organic solvent, then diluted into the aqueous reaction mixture. The most commonly used organic solvents for this purpose are dimethyl sulfoxide (DMSO) and dimethyl formamide (DMF), which are compatible with most proteins at low concentrations.
2) Sulfo-NHS-esters of biotin are more soluble in water, and are dissolved in water just before use because they hydrolyze easily. The water solubility of sulfo-NHS-esters stems from their sulfonate group on the N-hydroxysuccinimide ring and eliminates the need to dissolve the reagent in an organic solvent.

Chemical reactions of NHS- and sulfo-NHS-esters are essentially the same: an amide bond is formed and NHS or sulfo-NHS become leaving groups. Because the targets for the ester are deprotonated primary amines, the reaction is prevalent above pH 7. Hydrolysis of the NHS-ester is a major competing reaction, and the rate of hydrolysis increases with increasing pH. NHS- and sulfo-NHS-esters have a half-life of several hours at pH 7, but only a few minutes at pH 9. The conditions for conjugating NHS-esters to primary amines of peptides include incubation temperatures in the range 4-37° C., reaction pH values in the range 7-9, and incubation times from a few minutes to about 12 hours. Buffers containing amines (such as Tris or glycine) must be avoided because they compete with the reaction. The HABA dye (2-(4-hydroxyazobenzene) benzoic acid) method can be used to determine the extent of biotinylation. Briefly, HABA dye is bound to avidin and yields a characteristic absorbance. When biotin, in the form of biotinylated protein or other molecule, is introduced, it displaces the dye, resulting in a change in absorbance at 500 nm. The absorbance change is directly proportional to the level of biotin in the sample.

"4-pentynoylation" of an amino acid residue is typically by coupling 4-pentynoic acid via a standard amide bond reaction via the N-terminal or at a side chain. When appropriate for additional PEGylations, 4-pentynoylation can alternatively employ an alkyne in the copper-catalyzed 1,3-dipolar cycloaddition reaction (the so-called "Click" reaction) to react with the azide in the azido-PEG molecule to link the peptide and the PEG via a triazole.

An "isolated polypeptide" is a polypeptide molecule that is purified or separated from at least one contaminant polypeptide molecule with which it is ordinarily associated in the natural source of the polypeptide. An isolated polypeptide molecule is other than in the form or setting in which it is found in nature.

"Toxin peptides" include peptides and polypeptides having the same amino acid sequence of a naturally occurring pharmacologically active peptide or polypeptide that can be isolated from a venom, and also include modified peptide analogs of such naturally occurring molecules. (See, e.g., Kalman et al., ShK-Dap22, a potent Kv1.3-specific immunosuppressive polypeptide, J. Biol. Chem. 273(49):32697-707 (1998); Kem et al., U.S. Pat. No. 6,077,680; Mouhat et al., OsK1 derivatives, WO 2006/002850 A2; Chandy et al., Analogs of SHK toxin and their uses in selective inhibition of Kv1.3 potassium channels, WO 2006/042151; Sullivan et al., Toxin Peptide therapeutic agents, WO 2006/116156 A2, all of which are incorporated herein by reference in their entirety). Snakes, scorpions, spiders, bees, snails and sea anemone are a few examples of organisms that produce venom that can serve as a rich source of small bioactive toxin peptides or "toxins" that potently and selectively target ion channels and receptors. Some examples of toxins that inhibit voltage-gated sodium channels include JzTx-V (SEQ ID NO:2), JzTx-45 (YCQKWMWTCDSERKCCEGYVCELWCKYNL//SEQ ID NO:48), and JzTx-46 (YCQKWMWTCDSERKCCEGYVCELWCKYNM//SEQ ID NO:430), isolated from the venom of tarantula *Chilobrachys jingzhao*; GpTx-1 (Asp Cys Leu Gly Phe Met Arg Lys Cys Ile Pro Asp Asn Asp Lys Cys Cys Arg Pro Asn Leu Val Cys Ser Arg Thr His Lys Trp Cys Lys Tyr Val Phe-$NH_2$//SEQ ID NO:532) isolated from the venom of tarantula *Grammostola porteri*, Huwentoxin-IV (ECLEI FKACN PSNDQ CCKSS KLVCS RKTRW CKYQI-$NH_2$//SEQ ID NO:528) and Huwentoxin-I (ACKGV FDACT PGKNE CCPNR VCSDK HKWCK WKL//SEQ ID NO:529), isolated from the venom of tarantula *Ornithoctonus huwena*; KIIIA (CCNCS SKWCR DHSRC C-$NH_2$//SEQ ID NO:530) isolated from the venom of marine cone snail *Conus kinoshitai*; ProTxI (Glu Cys Arg Tyr Trp Leu Gly Gly Cys Ser Ala Gly Gln Thr Cys Cys Lys His Leu Val Cys Ser Arg Arg His Gly Trp Cys Val Trp Asp Gly Thr Phe Ser//SEQ ID NO:593) and ProTxII (YCQKW MWTCD SERKC CEGMV CRLWC KKKLW//SEQ ID NO:531) isolated from the venom of tarantula *Thrixopelma pruriens*. Another example is the alpha toxin OD1 (GVRDAYIADD KNCVYTCASN GYCNTECTKN GAESGYCQWI GRYGNACWCI KLPDEVPIRIPGKCR-$NH_2$//SEQ ID NO:589), a toxin isolated from the venom of the scorpion *Odonthobuthus doriae*. Another example of a toxin peptide is OSK1 (also known as OsK1), a toxin peptide isolated from *Orthochirus scrobiculosus* scorpion venom. (e.g., Mouhat et al., K+ channel types targeted by synthetic OSK1, a toxin from *Orthochirus scrobiculosus* scorpion venom, Biochem. J. 385:95-104 (2005); Mouhat et al., Pharmacological profiling of *Orthochirus scrobiculosus* toxin 1 analogs with a trimmed N-terminal domain, Molec. Pharmacol. 69:354-62 (2006); Mouhat et al., OsK1 derivatives, WO 2006/002850 A2). Another example is ShK, isolated from the venom of the sea anemone *Stichodactyla helianthus*, and its peptide analogs. (E.g., Tudor et al., Ionisation behaviour and solution properties of the potassium-channel blocker ShK toxin, Eur. J. Biochem. 251(1-2):133-41(1998); Pennington et al., Role of disulfide bonds in the structure and potassium channel blocking activity of ShK toxin, Biochem. 38(44): 14549-58 (1999); Kem et al., ShK toxin compositions and methods of use, U.S. Pat. No. 6,077,680; Lebrun et al., Neuropeptides originating in scorpion, U.S. Pat. No. 6,689,749; Beeton et al., Targeting effector memory T cells with a selective peptide inhibitor of Kv1.3 channnels for therapy of autoimmune diseases, Molec. Pharmacol. 67(4):1369-81 (2005); and Sullivan et al., Selective and potent peptide inhibitors of $K_V1.3$, WO 2010/108154 A2).

The toxin peptides are usually between about 20 and about 80 amino acids in length, contain 2-5 disulfide linkages and form a very compact structure. Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency and stability. The majority of scorpion and *Conus* toxin peptides, for example, contain 10-40 amino acids and up to five disulfide bonds, forming extremely compact and constrained structure (microproteins) often resistant to proteolysis. The conotoxin and scorpion toxin peptides can be divided into a number of superfamilies based on their disulfide connections and peptide folds. The solution structure of many toxin peptides has been determined by NMR spectroscopy, illustrating their compact structure and verifying conservation of family folding patterns. (E.g., Tudor et al., Ionisation behaviour and solution properties of the potassium-channel blocker ShK toxin, Eur. J. Biochem. 251(1-2):133-41(1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from *Orthochirus scrobiculosus* scorpion venom, Biochem. 36(6):1223-32 (1997); del Rio-Portillo et al.; NMR solution structure of Cn12, a novel peptide from the Mexican scorpion *Centruroides noxius* with a typical beta-toxin sequence but with alpha-like physiological activity, Eur. J. Biochem. 271(12): 2504-16 (2004); Prochnicka-Chalufour et al., Solution structure of discrepin, a new K+-channel blocking peptide from the alpha-KTx15 subfamily, Biochem. 45(6): 1795-1804 (2006)). Other examples are known in the art, or can be found in Sullivan et al., Toxin Peptide Therapeutic Agents, WO06116156 A2 or U.S. Pat. No. 7,833,979; Sullivan et al., Selective and potent peptide inhibitors of $K_V1.3$, WO 2010/108154 A2; Mouhat et al., OsK1 derivatives, WO 2006/002850 A2; Sullivan et al., U.S. patent application Ser. No. 11/978,076 (titled: filed 25 Oct. 2007), Lebrun et al., U.S. Pat. No. 6,689,749, which are each incorporated by reference in their entireties.

The term "peptide analog" refers to a peptide having a sequence that differs from a peptide sequence existing in nature by at least one amino acid residue substitution, internal addition, or internal deletion of at least one amino acid, and/or amino- or carboxy-terminal end truncations or additions, and/or carboxy-terminal amidation. An "internal deletion" refers to absence of an amino acid from a sequence existing in nature at a position other than the N- or C-terminus. Likewise, an "internal addition" refers to presence of an amino acid in a sequence existing in nature at a position other than the N- or C-terminus.

Embodiments of the inventive composition of matter includes a toxin peptide analog, or a pharmaceutically acceptable salt thereof "Toxin peptide analogs" contain modifications of a native toxin peptide sequence of interest (e g, amino acid residue substitutions, internal additions or insertions, internal deletions, and/or amino- or carboxy-terminal end truncations, or additions as previously described above) relative to a native toxin peptide sequence of interest, such as JzTx-V (YCQKWMWTCDSKRACCEGLRCKLWCRKII-$NH_2$//SEQ ID NO:2). Toxin peptide analogs of the present invention are 20 to about 80 amino acid residues long and, in relation to SEQ ID NO:2, have $C^1$-$C^4$, $C^2$-$C^5$ and $C^3$-$C^6$ disulfide (or diselenide) bonding in which, $C^1$, $C^2$, $C^3$, $C^4$, $C^5$ and $C^6$ represent the order of cysteine (or selenocysteine) residues appearing in the primary sequence of the toxin peptide stated conventionally with the N-terminus of the peptide(s) on the left, with the first and sixth cysteines (or selenocysteines) in the amino acid sequence forming a disulfide bond (or diselenide bond, if SeCys), the second and fourth cysteines (or selenocysteines) forming a disulfide bond (or diselenide bond, if SeCys), and the third and fifth cysteines (or selenocysteines) forming a disulfide bond (or diselenide bond, if SeCys). As described herein, the toxin peptide analogs of the present invention can also have additional amino acid residues at the N-terminal and/or C-terminal ends, in relation to SEQ ID NO:2.

By "physiologically acceptable salt" of the composition of matter, for example a salt of the toxin peptide analog, is meant any salt or salts that are known or later discovered to be pharmaceutically acceptable. Some non-limiting examples of pharmaceutically acceptable salts are: acetate; trifluoroacetate; hydrohalides, such as hydrochloride and hydrobromide; sulfate; citrate; maleate; tartrate; glycolate; gluconate; succinate; mesylate; besylate; salts of gallic acid esters (gallic acid is also known as 3,4,5 trihydroxybenzoic acid) such as PentaGalloylGlucose (PGG) and epigallocatechin gallate (EGCG), salts of cholesteryl sulfate, pamoate, tannate and oxalate salts.

The term "fusion protein" indicates that the protein includes polypeptide components derived from more than one parental protein or polypeptide. Typically, a fusion protein is expressed from a fusion gene in which a nucleotide sequence encoding a polypeptide sequence from one protein is appended in frame with, and optionally separated by a linker from, a nucleotide sequence encoding a polypeptide sequence from a different protein. The fusion gene can then be expressed by a recombinant host cell as a single protein.

The terms "-mimetic peptide," "peptide mimetic," and "-agonist peptide" refer to a peptide or protein having biological activity comparable to a naturally occurring protein of interest, for example, but not limited to, a toxin peptide molecule. These terms further include peptides that indirectly mimic the activity of a naturally occurring peptide molecule, such as by potentiating the effects of the naturally occurring molecule.

The term "-antagonist peptide," "peptide antagonist," and "inhibitor peptide" refer to a peptide that blocks or in some way interferes with the biological activity of a receptor of interest, or has biological activity comparable to a known antagonist or inhibitor of a receptor of interest, such as, but not limited to, an ion channel (e.g., Nav1.7 or Nav1.3) or a G-Protein Coupled Receptor (GPCR).

A "domain" of a protein is any portion of the entire protein, up to and including the complete protein, but typically comprising less than the complete protein. A domain can, but need not, fold independently of the rest of the protein chain and/or be correlated with a particular biological, biochemical, or structural function or location (e.g., a ligand binding domain, or a cytosolic, transmembrane or extracellular domain).

As used herein "soluble" when in reference to a protein produced by recombinant DNA technology in a host cell is a protein that exists in aqueous solution; if the protein contains a twin-arginine signal amino acid sequence the soluble protein is exported to the periplasmic space in gram negative bacterial hosts, or is secreted into the culture medium by eukaryotic host cells capable of secretion, or by bacterial host possessing the appropriate genes (e.g., the kil gene). Thus, a soluble protein is a protein which is not found in an inclusion body inside the host cell. Alternatively, depending on the context, a soluble protein is a protein which is not found integrated in cellular membranes. In contrast, an insoluble protein is one which exists in denatured form inside cytoplasmic granules (called an inclusion body) in the host cell, or again depending on the context, an insoluble protein is one which is present in cell membranes, including but not limited to, cytoplasmic membranes, mitochondrial membranes, chloroplast membranes, endoplasmic reticulum membranes, etc.

A distinction is also drawn between proteins which are "soluble" (i.e., dissolved or capable of being dissolved) in an aqueous solution devoid of significant amounts of ionic detergents (e.g., SDS) or denaturants (e.g., urea, guanidine hydrochloride) and proteins which exist as a suspension of insoluble protein molecules dispersed within the solution. A "soluble" protein will not be removed from a solution containing the protein by centrifugation using conditions sufficient to remove cells present in a liquid medium (e.g., centrifugation at 5,000×g for 4-5 minutes). In some embodiments of the inventive composition, the toxin peptide analog is synthesized by the host cell and segregated in an insoluble form within cellular inclusion bodies, which can then be purified from other cellular components in a cell extract with relative ease, and the toxin peptide analog can in turn be solubilized, refolded and/or further purified.

A distinction is drawn between a "soluble" protein (i.e., a protein which when expressed in a host cell is produced in a soluble form) and a "solubilized" protein. An insoluble recombinant protein found inside an inclusion body or found integrated in a cell membrane may be solubilized (i.e., rendered into a soluble form) by treating purified inclusion bodies or cell membranes with denaturants such as guanidine hydrochloride, urea or sodium dodecyl sulfate (SDS). These denaturants must then be removed from the solubilized protein preparation to allow the recovered protein to renature (refold). Although the inventive compositions can be refolded in active form, not all proteins will refold into an active conformation after solubilization in a denaturant and removal of the denaturant. Many proteins precipitate upon removal of the denaturant. SDS may be used to solubilize inclusion bodies and cell membranes and will maintain the proteins in solution at low concentration. However, dialysis will not always remove all of the SDS (SDS can form micelles which do not dialyze out); therefore, SDS-solubilized inclusion body protein and SDS-solubilized cell membrane protein is soluble but not refolded.

A "secreted" protein refers to those proteins capable of being directed to the ER, secretory vesicles, or the extracellular space as a result of a secretory signal peptide sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage. In some other embodiments of the inventive composition, the toxin peptide analog can be synthesized by the host cell as a secreted protein, which can then be further purified from the extracellular space and/or medium.

The term "recombinant" indicates that the material (e.g., a nucleic acid or a polypeptide) has been artificially or synthetically (i.e., non-naturally) altered by human intervention. The alteration can be performed on the material within, or removed from, its natural environment or state. For example, a "recombinant nucleic acid" is one that is made by recombining nucleic acids, e.g., during cloning, DNA shuffling or other well known molecular biological procedures. Examples of such molecular biological procedures are found in Maniatis et al., Molecular Cloning. A Laboratory Manual. Cold Spring Harbor Laboratory, Cold Spring Harbor, N.Y. (1982). A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid.

The term "polynucleotide" or "nucleic acid" includes both single-stranded and double-stranded nucleotide polymers containing two or more nucleotide residues. The nucleotide residues comprising the polynucleotide can be ribonucleotides or deoxyribonucleotides or a modified form of either type of nucleotide. Said modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phosphoraniladate and phosphoroamidate.

The term "oligonucleotide" means a polynucleotide comprising 200 or fewer nucleotide residues. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including an isotopic label (e.g., $^{125}I$, $^{14}C$, $^{13}C$, $^{35}S$, $^{3}H$, $^{2}H$, $^{13}N$, $^{15}N$, $^{18}O$, $^{17}O$, etc.), for ease of quantification or detection, a fluorescent label, a hapten or an antigenic label, for detection assays. Oligonucleotides may be used, for example, as PCR primers, cloning primers or hybridization probes.

A "polynucleotide sequence" or "nucleotide sequence" or "nucleic acid sequence," as used interchangeably herein, is the primary sequence of nucleotide residues in a polynucleotide, including of an oligonucleotide, a DNA, and RNA, a nucleic acid, or a character string representing the primary sequence of nucleotide residues, depending on context. From any specified polynucleotide sequence, either the given nucleic acid or the complementary polynucleotide sequence can be determined Included are DNA or RNA of genomic or synthetic origin which may be single- or double-stranded, and represent the sense or antisense strand. Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

As used herein, an "isolated nucleic acid molecule" or "isolated nucleic acid sequence" is a nucleic acid molecule that is either (1) identified and separated from at least one contaminant nucleic acid molecule with which it is ordinarily associated in the natural source of the nucleic acid or (2) cloned, amplified, tagged, or otherwise distinguished from background nucleic acids such that the sequence of the nucleic acid of interest can be determined. An isolated nucleic acid molecule is other than in the form or setting in which it is found in nature. However, an isolated nucleic acid molecule includes a nucleic acid molecule contained in cells that ordinarily express a polypeptide (e.g., an oligopeptide or antibody) where, for example, the nucleic acid molecule is in a chromosomal location different from that of natural cells.

As used herein, the terms "nucleic acid molecule encoding," "DNA sequence encoding," and "DNA encoding" refer to the order or sequence of deoxyribonucleotides along a strand of deoxyribonucleic acid. The order of these deoxyribonucleotides determines the order of ribonucleotides along the mRNA chain, and also determines the order of amino acids along the polypeptide (protein) chain. The DNA sequence thus codes for the RNA sequence and for the amino acid sequence.

The term "gene" is used broadly to refer to any nucleic acid associated with a biological function. Genes typically include coding sequences and/or the regulatory sequences required for expression of such coding sequences. The term "gene" applies to a specific genomic or recombinant sequence, as well as to a cDNA or mRNA encoded by that sequence. A "fusion gene" contains a coding region that encodes a polypeptide with portions from different proteins that are not naturally found together, or not found naturally together in the same sequence as present in the encoded fusion protein (i.e., a chimeric protein). Genes also include non-expressed nucleic acid segments that, for example, form recognition sequences for other proteins. Non-expressed regulatory sequences including transcriptional control elements to which regulatory proteins, such as transcription factors, bind, resulting in transcription of adjacent or nearby sequences.

"Expression of a gene" or "expression of a nucleic acid" means transcription of DNA into RNA (optionally including modification of the RNA, e.g., splicing), translation of RNA into a polypeptide (possibly including subsequent post-translational modification of the polypeptide), or both transcription and translation, as indicated by the context.

As used herein the term "coding region" or "coding sequence" when used in reference to a structural gene refers to the nucleotide sequences which encode the amino acids found in the nascent polypeptide as a result of translation of an mRNA molecule. The coding region is bounded, in eukaryotes, on the 5' side by the nucleotide triplet "ATG" which encodes the initiator methionine and on the 3' side by one of the three triplets which specify stop codons (i.e., TAA, TAG, TGA).

The term "control sequence" or "control signal" refers to a polynucleotide sequence that can, in a particular host cell, affect the expression and processing of coding sequences to which it is ligated. The nature of such control sequences may depend upon the host organism. In particular embodiments, control sequences for prokaryotes may include a promoter, a ribosomal binding site, and a transcription termination sequence. Control sequences for eukaryotes may include promoters comprising one or a plurality of recognition sites for transcription factors, transcription enhancer sequences or elements, polyadenylation sites, and transcription termination sequences. Control sequences can include leader sequences and/or fusion partner sequences. Promoters and enhancers consist of short arrays of DNA that interact specifically with cellular proteins involved in transcription (Maniatis, et al., Science 236:1237 (1987)). Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. Some eukaryotic promoters and enhancers have a broad host range while others are functional in a limited subset of cell types (for review see Voss, et al., Trends Biochem. Sci., 11:287 (1986) and Maniatis, et al., Science 236:1237 (1987)).

The term "vector" means any molecule or entity (e.g., nucleic acid, plasmid, bacteriophage or virus) used to transfer protein coding information into a host cell.

The term "expression vector" or "expression construct" as used herein refers to a recombinant DNA molecule containing a desired coding sequence and appropriate nucleic acid control sequences necessary for the expression of the operably linked coding sequence in a particular host cell. An expression vector can include, but is not limited to, sequences that affect or control transcription, translation, and, if introns are present, affect RNA splicing of a coding region operably linked thereto. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. Such techniques are well known in the art. (E.g., Goodey, Andrew R.; et al., Peptide and DNA sequences, U.S. Pat. No. 5,302,697; Weiner et al., Compositions and methods for protein secretion, U.S. Pat. Nos. 6,022,952 and 6,335,178; Uemura et al., Protein expression vector and utilization thereof, U.S. Pat. No. 7,029,909; Ruben et al., 27 human secreted proteins, US 2003/0104400 A1).

The terms "in operable combination", "in operable order" and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed, or is capable of being transformed, with a nucleic acid and thereby expresses a gene of interest. The term includes the progeny of the parent cell, whether or not the progeny is identical in morphology or in genetic make-up to the original parent cell, so long as the gene of interest is present. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK-293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art.

The term "transfection" means the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., 1973, Virology 52:456; Sambrook et al., 2001, Molecular Cloning: A Laboratory Manual, supra; Davis et al., 1986, Basic Methods in Molecular Biology, Elsevier; Chu et al., 1981, Gene 13:197. Such techniques can be used to introduce one or more exogenous DNA moieties into suitable host cells.

The term "transformation" refers to a change in a cell's genetic characteristics, and a cell has been transformed when it has been modified to contain new DNA or RNA. For example, a cell is transformed where it is genetically modified from its native state by introducing new genetic material via transfection, transduction, or other techniques. Following transfection or transduction, the transforming DNA may recombine with that of the cell by physically integrating into a chromosome of the cell, or may be maintained transiently as an episomal element without being replicated, or may replicate independently as a plasmid. A cell is considered to have been "stably transformed" when the transforming DNA is replicated with the division of the cell.

The term "transgene" refers to an isolated nucleotide sequence, originating in a different species from the host, that may be inserted into one or more cells of a mammal or mammalian embryo. The transgene optionally may be operably linked to other genetic elements (such as a promoter, poly A sequence and the like) that may serve to modulate, either directly, or indirectly in conjunction with the cellular machinery, the transcription and/or expression of the transgene. Alternatively or additionally, the transgene may be linked to nucleotide sequences that aid in integration of the transgene into the chromosomal DNA of the mammalian cell or embryo nucleus (as for example, in homologous recombination). The transgene may be comprised of a nucleotide sequence that is either homologous or heterologous to a particular nucleotide sequence in the mammal's endogenous genetic material, or is a hybrid sequence (i.e. one or more portions of the transgene are homologous, and one or more portions are heterologous to the mammal's genetic material). The transgene nucleotide sequence may encode a polypeptide or a variant of a polypeptide, found endogenously in the mammal, it may encode a polypeptide not naturally occurring in the mammal (i.e. an exogenous polypeptide), or it may encode a hybrid of endogenous and exogenous polypeptides. Where the transgene is operably linked to a promoter, the promoter may be homologous or heterologous to the mammal and/or to the transgene. Alternatively, the promoter may be a hybrid of endogenous and exogenous promoter elements (enhancers, silencers, suppressors, and the like).

Peptides.

Recombinant DNA- and/or RNA-mediated protein expression and protein engineering techniques, or any other methods of preparing peptides, are applicable to the making of the inventive polypeptides, e.g., toxin peptide analogs and fusion protein conjugates thereof (e.g., fusion proteins containing a toxin peptide analog and an immunoglobulin Fc domain, transthyretin, human serum albumin, or a lipid or albumin binding peptide). For example, the peptides can be made in transformed host cells. Briefly, a recombinant DNA molecule, or construct, coding for the peptide is prepared. Methods of preparing such DNA molecules are well known in the art. For instance, sequences encoding the peptides can be excised from DNA using suitable restriction enzymes. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art. In addition, the DNA optionally further encodes, 5' to the coding region of a fusion protein, a signal peptide sequence (e.g., a secretory signal peptide) operably linked to the expressed toxin peptide analog. For further examples of appropriate recombinant methods and exemplary DNA constructs useful for recombinant expression of the inventive compositions by mammalian cells, including dimeric Fc fusion proteins ("peptibodies") or chimeric immunoglobulin (light chain+heavy chain)-Fc heterotrimers ("hemibodies"), conjugated to pharmacologically active toxin peptide analogs of the invention, see, e.g., Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties.

Peptide compositions of the present invention can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Suitable techniques are well known in the art. (E.g., Merrifield (1973), Chem. Polypeptides, pp. 335-61 (Katsoyannis and Panayotis eds.); Merrifield (1963), J. Am. Chem. Soc. 85: 2149; Davis et al. (1985), Biochem. Intl. 10: 394-414; Stewart and Young (1969), Solid Phase Peptide Synthesis; U.S. Pat. No. 3,941,763; Finn et al. (1976), The Proteins (3rd ed.) 2: 105-253; and Erickson et al. (1976), The Proteins (3rd ed.) 2: 257-527; "Protecting Groups in Organic Synthesis," 3rd Edition, T. W. Greene and P. G. M. Wuts, Eds., John Wiley & Sons, Inc., 1999; NovaBiochem Catalog, 2000; "Synthetic Peptides, A User's Guide," G. A. Grant, Ed., W.H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000, G. B. Fields et al., Synthetic Peptides: A User's Guide, 1990, 77-183). For further examples of synthetic and purification methods known in the art, which are applicable to making the inventive compositions of matter, see, e.g., Sullivan et al., Toxin Peptide Therapeutic Agents, US2007/0071764 and Sullivan et al., Toxin Peptide Therapeutic Agents, PCT/US2007/022831, published as WO 2008/088422 A2, which are both incorporated herein by reference in their entireties.

In further describing the toxin peptide analogs herein, a one-letter abbreviation system is frequently applied to designate the identities of the twenty "canonical" amino acid residues generally incorporated into naturally occurring peptides and proteins (Table 2). Such one-letter abbreviations are entirely interchangeable in meaning with three-letter abbreviations, or non-abbreviated amino acid names. Within the one-letter abbreviation system used herein, an upper case letter indicates a L-amino acid, and a lower case letter indicates a D-amino acid. For example, the abbreviation "R" designates L-arginine and the abbreviation "r" designates D-arginine.

TABLE 2

One-letter abbreviations for the canonical amino acids. Three-letter abbreviations are in parentheses.

| | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence is typically designated herein with a one-letter abbreviation for the amino acid residue in a particular position, followed by the numerical amino acid position relative to a native sequence of interest, which is then followed by the one-letter symbol for the amino acid residue substituted in. For example, "T30D" symbolizes a substitution of a threonine residue by an aspartate residue at amino acid position 30, relative to the native sequence of interest.

Non-canonical amino acid residues can be incorporated into a peptide within the scope of the invention by employing known techniques of protein engineering that use recombinantly expressing cells. (See, e.g., Link et al., Non-canonical amino acids in protein engineering, Current Opinion in Biotechnology, 14(6):603-609 (2003)). The term "non-canonical amino acid residue" refers to amino acid residues in D- or L-form that are not among the 20 canonical amino acids generally incorporated into naturally occurring proteins, for example, β-amino acids, homoamino acids, cyclic amino acids and amino acids with derivatized side chains. Examples include (in the L-form or D-form) β-alanine, β-aminopropionic acid, piperidinic acid, aminocaprioic acid, aminoheptanoic acid, aminopimelic acid, desmosine, diaminopimelic acid, $N^{\alpha}$-ethylglycine, $N^{\alpha}$-ethylaspargine, hydroxylysine, allo-hydroxylysine, isodesmosine, allo-isoleucine, ω-methylarginine, $N^{\alpha}$-methylglycine, $N^{\alpha}$-methylisoleucine, $N^{\alpha}$-methylvaline, γ-carboxyglutamate, ε-N,N,N-trimethyllysine, ε-N-acetyllysine, O-phosphoserine, $N^{\alpha}$-acetylserine, $N^{\alpha}$-formylmethionine, 3-methylhistidine, 5-hydroxylysine, and other similar amino acids, and those listed in Table 3 below, and derivatized forms of any of these as described herein. Table 3 contains some exemplary non-canonical amino acid residues that are useful in accordance with the present invention and associated abbreviations as typically used herein, although the skilled practitioner will understand that different abbreviations and nomenclatures may be applicable to the same substance and appear interchangeably herein. Some amino acid sequences, as recited herein may include "{H}-" at the N-terminal, which represents an N-terminal amino group, and/or may include "-{Free Acid}" at the C-terminal, which represents a C-terminal carboxy group.

TABLE 3

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| Acetamidomethyl | Acm |
| Acetylarginine | acetylarg |
| α-aminoadipic acid | Aad |
| aminobutyric acid | Abu |
| 2-aminobutyric acid | 2-Abu |
| 6-aminohexanoic acid | Ahx; εAhx |
| L-azidohomoalanine | Aha |
| 3-amino-6-hydroxy-2-piperidone | Ahp |
| 2-aminoindane-2-carboxylic acid | Aic |
| α-amino-isobutyric acid | Aib |
| L-allylglycine | AllylG |
| 3-amino-2-naphthoic acid | Anc |
| 2-aminotetraline-2-carboxylic acid | Atc |
| Aminophenylalanine | Aminophe; Amino-Phe |
| 4-amino-phenylalanine (also known as para-aminophenylalanine) | 4AmP; 4-AminoF; 4-Amino-Phe |
| 4-amidino-phenylalanine | 4AmPhe |
| 2-amino-2-(1-carbamimidoylpiperidin-4-yl)acetic acid | 4AmPig |
| ω-N-methylarginine | R(Me) |
| Arg ψ($CH_2$NH) -reduced amide bond | rArg |
| 3-(1,2,3-triazol-4-yl)Alanine | Atz |
| Atz((S)-2-amino-3-(1-(5,21-dioxo-1-((3aS,4S,6aR)-2-oxohexahydro-1H-thieno[3,4-d]imidazol-4-yl)-9,12,15,18-tetraoxa-6,22-diazaoctacosan-28-yl)-1H-1,2,3-triazol-4-yl)propanoic acid | [Atz](ClickBiotin) |
| (S)-15-(4-(2-amino-2-carboxyethyl)-1H-1,2,3-triazol-1-yl)pentadecanoic acid | [Atz](palmitate) |
| (3S,6S,9S,12S,15S,18S)-6-((1H-indol-3-yl)methyl)-3-(((2S,3S)-1-(((3S,6S,12R,17R,20S,25aS)-6-((1H-indol-3-yl)methyl)-12-(((2R,5S,8S,11S,14S)-11-((1H-indol-3-yl)methyl)-1-amino-8-(2-carboxyethyl)-2,5-bis(carboxymethyl)-16-methyl-1,4,7,10,13-pentaoxo-3,6,9,12-tetraazaheptadecan-14-yl)carbamoyl)-3-(3-guanidinopropyl)-20-isobutyl-1,4,7,10,18,21-hexaoxodocosahydro-1H-pyrrolo[2,1-p][1,2,5,8,11,14,17,20]dithiahexaazacyclotricosin-17-yl)amino)-3-methyl-1-oxopentan-2-yl)carbamoyl)-36-(4-((S)-2-amino-2-carboxyethyl)-1H-1,2,3-triazol-1-yl)-9-((S)-sec-butyl)-15-(3-guanidinopropyl)-18-(hydroxymethyl)-12-isobutyl-5,8,11,14,17,20,23,26,29,32-decaoxo-4,7,10,13,16,19,22,25,28,31-decaazahexatriacontan-1-oic acid | Atz(pentanoyl-GGGGS-SA21) |
| (S)-2-amino-3-(1-(1-bromo-2-oxo-6,9,12-trioxa-3-azatetradecan-14-yl)-1H-1,2,3-triazol-4-yl)propanoic acid | Atz(PEG3-bromoacetamide) |
| (S)-2-amino-3-(1-(32-amino-3,6,9,12,15,18,21,24,27,30-decaoxadotriacontyl)-1H-1,2,3-triazol-4-yl)propanoic acid | Atz(NPEG9) |
| (S)-2-amino-3-(1-(1-amino-3,6,9,12,15,18,21,24,27,30-decaoxatritriacontan-33-yl)-1H-1,2,3-triazol-4-yl)propanoic acid | Atz(NPEG10)or Atz(PEG10)or Pra(NPEG9) |
| 3-(1-(O-(aminoethyl)-O'-(ethylene)-decaethyleneglycol)-1,2,3-triazol-4-yl)Alanine | Atz(amino-PEG10) |
| 3-(1-(O-(aminoethyl)-O'-(ethylene)-ethyleneglycol450avg)-1,2,3-triazol-4-yl)Alanine | Atz(20 kDa PEG) |
| (S)-2-amino-3-(1-(2-oxo-6,9,12,15,18,21,24,27,30,33,36-undecaoxa-3-azaoctatriacontan-38-yl)-1H-1,2,3-triazol-4-yl)propanoic acid | Atz(PEG11-(acetamidomethyl) |
| (S)-2-amino-3-(1-(4-oxo-1-phenyl-8,11,14,17,20,23,26,29,32,35,38-undecaoxa-2-thia-5-azatetracontan-40-yl)-1H-1,2,3-triazol-4-yl)propanoic acid | Atz(PEG11-benzylthioacetamide) |
| (S)-2-amino-3-(1-(1-hydroxy-5-oxo-9,12,15,18,21,24,27,30,33,36,39-undecaoxa-3-thia-6-azahentetracontan-41-yl)-1H-1,2,3-triazol-4-yl)propanoic acid | Atz(PEG11-((2-hydroxyethyl)thio)acetamide) |
| (S)-2-amino-3-(1-(1-bromo-2-oxo-6,9,12,15,18,21,24,27,30,33,36-undecaoxa-3-azaoctatriacontan-38-yl)-1H-1,2,3-triazol-4-yl)propanoic acid | Atz(PEG11-bromoacetamide) |
| (2S,2'S)-3,3'-(1,1'-(1,1'-(5-((2-(benzylthio)acetamido)methyl)-1,3-phenylene)bis(1-oxo-5,8,11,14,17,20,23,26,29,32,35,38,41,44,47,50,53,56,59,62,65,68,71-tricosaoxa-2-azatriheptacontane-73,1-diyl))bis(1H-1,2,3-triazole-4,1-diyl))bis(2-aminopropanoic acid) | Bis-[Atz(PEG23)]-benzylthioacetamide |
| (S)-2-amino-6-((S)-2-amino-3-(1-(32-amino-3,6,9,12,15,18,21,24,27,30-decaoxadotriacontyl)-1H-1,2,3-triazol-4-yl)propanamido)hexanoic acid | KAtzNP10 or KAtzNPEG10 |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| (2S,25S)-2,25-diamino-1-(1-(32-amino-3,6,9,12,15,18,21,24,27,30-decaoxadotriacontyl)-1H-1,2,3-triazol-4-yl)-3,19-dioxo-7,10,13,16-tetraoxa-4,20-diazahexacosan-26-oic acid | KAP4P10 |
| (S)-2-amino-6-(3-(1-(1-bromo-2-oxo-6,9,12,15,18,21,24,27,30,33,36-undecaoxa-3-azaoctatriacontan-38-yl)-1H-1,2,3-triazol-4-yl)propanamido)hexanoic acid | K(ethyl-triazole-PEG11-bromoacetamide) |
| L-azidolysine | AzK |
| β-alanine | bA |
| β-homoarginine | bhArg |
| β-homolysine | bhomoK |
| β-homoglutamine | BhGln or hGln |
| β-homo Tic | BhTic |
| β-homophenylalanine (or homophenylalanine) | BhPhe or hPhe or homoPhe |
| bishomopropargylglycine | BhPra |
| β-homoproline | BhPro |
| β-homotryptophan | BhTrp |
| 4,4'-biphenylalanine; 4-phenyl-phenylalanine; or biphenylalanine | Bip; 4Bip |
| β,β-diphenyl-alanine | BiPhA |
| β-phenylalanine | BPhe |
| p-carboxyl-phenylalanine | Cpa |
| 4-chloro-L-phenylalanine | 4-Cl—F |
| (2S,5S)-14-bromo-2-ethyl-5-(hydroxymethyl)-4,7,10,13-tetraoxo-3,6,9,12-tetraazatetradecan-1-oic acid | Bromoacetyl-GGS[Aha]-Amide |
| Citrulline | Cit |
| Cyclohexylalanine | Cha |
| Cyclohexylglycine | Chg |
| Cyclopentylglycine | Cpg |
| L-cyano-β-alanine | CyA |
| 4-tert-butyl-L-phenylalanine | 4tBu—F or 4-tBu—F |
| 4-benzoyl-L-phenylalanine | 4-Bz-F |
| 2-chloro-L-phenylalanine | 2-Cl—F |
| 4-trifluoromethyl-L-phenylalanine | 4CF3—F |
| 4-fluoro-L-phenylalanine | 4-F—F |
| 4-methyl-L-phenylalanine | 4-Me—F |
| 2-amino-3-guanidinopropanoic acid | 3G-Dpr |
| α,γ-diaminobutyric acid | Dab |
| 2,4-diaminobutyric acid | Dbu |
| diaminopropionic acid | Dap |
| 3,4-dichloro-L-phenylalanine | DiCl—F |
| 3,4-dimethoxy-L-phenylalanine | DiMeO—F |
| α,β-diaminopropionoic acid (or 2,3-diaminopropionic acid | Dpr |
| 3,3-diphenylalanine | Dip |
| ethynylphenylalanine | EPA |
| L-butynylglycine or (S)-2-amino-4-hexynoic acid | BtnG |
| 4-guanidino phenylalanine | Guf |
| 4-guanidino proline | 4GuaPr |
| Homoarginine | hArg; hR |
| Homocitrulline | hCit |
| Homoglutamine | hQ |
| Homoleucine | hLeu; hL |
| Homolysine | hLys; hK; homoLys |
| homopropargylglycine | hPra |
| 4-hydroxyproline (or hydroxyproline) | Hyp |
| 2-indanylglycine (or indanylglycine) | IgI |
| indoline-2-carboxylic acid | Idc |
| Iodotyrosine | I-Tyr |
| (S)-2-amino-6-((S)-2-aminopent-4-ynamido)hexanoic acid | Lys(Pra) or K(Pra) |
| (S)-2-amino-6-(6-((S)-2-aminopent-4-ynamido)hexanamido)hexanoic acid | Lys(Pra-Ahx) |
| (3S,6S,9S,12S,15S,18S)-6-((1H-indol-3-yl)methyl)-3-(((2S,3S)-1-(((3S,6S,12R,17R,20S,25aS)-6-((1H-indol-3-yl)methyl)-12-(((2R,5S,8S,11S,14S)-11-((1H-indol-3-yl)methyl)-1-amino-8-(2-carboxyethyl)-2,5-bis(carboxymethyl)-16-methyl-1,4,7,10,13-pentaoxo-3,6,9,12-tetraazaheptadecan-14-yl)carbamoyl)-3-(3-guanidinopropyl)-20-isobutyl-1,4,7,10,18,21-hexaoxodocosahydro-1H-pyrrolo[2,1-p][1,2,5,8,11,14,17,20]dithiahexaazacyclotricosin-17-yl)amino)-3-methyl-1-oxopentan-2-yl)carbamoyl)-36-(4-((S)-2-amino-3-(((S)-5-amino-5-carboxypentyl)amino)-3-oxopropyl)-1H-1,2,3- | Lys(Atz(pentanoyl-GGGGS-SA21)) |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| triazol-1-yl)-9-((S)-sec-butyl)-15-(3-guanidinopropyl)-18-(hydroxymethyl)-12-isobutyl-5,8,11,14,17,20,23,26,29,32-decaoxo-4,7,10,13,16,19,22,25,28,31-decaazahexatriacontan-1-oic acid | |
| (4S,51S)-4,51-diamino-5,45-dioxo-9,12,15,18,21,24,27,30,33,36,39,42-dodecaoxa-6,46-diazadopentacont-1-yn-52-oic acid | Lys(Pra-NPEG11) |
| (4S,27S)-4,27-diamino-5,21-dioxo-9,12,15,18-tetraoxa-6,22-diazaoctacos-1-yn-28-oic acid | Lys(Pra-NPEG3) or KPPG3 |
| Lys ψ($CH_2$NH)-reduced amide bond | rLys |
| (S)-6-((S)-2-acetamidopent-4-ynamido)-2-aminohexanoic acid | K(Ac-Pra) |
| N-ε-biotinyl-L-lysine | K(Biotin) |
| (S)-2,2',2''-(10-(2-((5-amino-5-carboxypentyl)amino)-2-oxoethyl)-1,4,7,10-tetraazacyclododecane-1,4,7-triyl)triacetic acid | K(DOTA) |
| (S)-2-amino-6-(pent-4-ynamido)hexanoic acid | K(4-Pen) |
| methionine oxide | Met[O] |
| methionine sulfone | $Met[O]_2$ |
| $N^{\alpha}$-methylarginine | NMeR |
| Nα-[$(CH_2)_3$NHCH(NH)$NH_2$] substituted glycine | N-Arg |
| $N^{\alpha}$-methylcitrulline | NMeCit |
| $N^{\alpha}$-methylglutamine | NMeQ |
| $N^{\alpha}$-methylhomocitrulline | $N^{\alpha}$-MeHoCit |
| $N^{\alpha}$-methylhomolysine | NMeHoK |
| $N^{\alpha}$-methylleucine | $N^{\alpha}$-MeL; NMeL; NMeLeu; NMe-Leu |
| $N^{\alpha}$-methyllysine | NMe-Lys |
| Nε-methyl-lysine | N-eMe-K |
| Nε-ethyl-lysine | N-eEt-K |
| Nε-isopropyl-lysine | N-eIPr-K |
| $N^{\alpha}$-methylnorleucine | NMeNle; NMe-Nle |
| $N^{\alpha}$-methylornithine | $N^{\alpha}$-MeOrn; NMeOrn |
| $N^{\alpha}$-methylphenylalanine | NMe-Phe |
| 1'N-methyltryptophan | 1'NMeW |
| 4-methyl-phenylalanine | MePhe |
| α-methylphenyalanine | AMeF |
| $N^{\alpha}$-methylthreonine | NMe-Thr; NMeThr |
| $N^{\alpha}$-methylvaline | NMeVal; NMe-Val |
| Nε-(O-(aminoethyl)-O'-(2-propanoyl)-undecaethyleneglycol)-Lysine | K(NPeg11) |
| Nε-(O-(aminoethyl)-O'-(2-propanoyl)-(ethyleneglycol)27-Lysine | K(NPeg27) |
| 3-(1-naphthyl)alanine | 1-Nal; 1Nal |
| 3-(2-naphthyl)alanine | 2-Nal; 2Nal |
| nipecotic acid | Nip |
| Nitrophenylalanine | nitrophe |
| norleucine | Nle |
| norvaline | Nva or Nvl |
| O-methyltyrosine | Ome-Tyr |
| (S)-octylglycine | OctylG |
| octahydroindole-2-carboxylic acid | Oic |
| Ornithine | Orn |
| Orn ψ(CH2NH)-reduced amide bond | rOrn |
| pyroglutamic acid | pGlu; PE; pE |
| L-phosphoserine | pS |
| 4-piperidinylalanine | 4PipA |
| 4-pyridinylalanine | 4Pal |
| 3 -pyridinylalanine | 3Pal |
| 2-pyridinylalanine | 2Pal |
| para-iodophenylalanine (or 4-iodophenylalanine) | pI-Phe |
| Phenylglycine | Phg |
| Propargylglycine | Pra |
| pipecolic acid | Pip |
| 4-amino-1-piperidine-4-carboxylic acid | 4Pip |
| Sarcosine | Sar |
| 1,2,3,4-tetrahydroisoquinoline | Tic |
| 1,2,3,4-tetrahydroisoquinoline-1-carboxylic acid | Tiq |
| 1,2,3,4-tetrahydroisoquinoline-7-hydroxy-3-carboxylic acid | Hydroxyl-Tic |
| 1,2,3,4-tetrahydronorharman-3-carboxylic acid | Tpi |
| thiazolidine-4-carboxylic acid | Thz |
| 3-thienylalanine | Thi |
| (S)-tert-butylglycine | Tle |
| symmetrical N'-ω-dimethyl arginine | SDMA |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| N-ε-dimethyl lysine | K(Me2) |
| 4-carboxyphenylalanine | 4CO2—F |
| 5-Bromotryptophan | 5-BrW |
| 6-Bromotryptophan | 6-BrW |
| 7-Bromotryptophan | 7-BrW |
| 5-Chlorotryptophan | 5-ClW |
| 6-Methyltryptophan | 6-MeW |
| 2-Bromohomophenylalanine | 2-BrhF |
| 2-Chlorohomophenylalanine | 2-ClhF |
| 2-Fluorohomophenylalanine | 2-FhF |
| 2-Methylhomophenylalanine | 2-MehF |
| 2-Methoxyhomophenylalanine | 2-MeOhF |
| 3-Bromohomophenylalanine | 3-BrhF |
| 3-Chlorohomophenylalanine | 3-ClhF |
| 3-Fluorohomophenylalanine | 3-FhF |
| 3-Methylhomophenylalanine | 3-MehF |
| 3-Methoxyhomophenylalanine | 3-MeOhF |
| 4-Bromohomophenylalanine | 4-BrhF |
| 4-Chlorohomophenylalanine | 4-ClhF |
| 4-Fluorohomophenylalanine | 4-FhF |
| 4-Methylphenylalanine | 4-Me—F |
| 4-Methylhomophenylalanine | 4-MehF |
| 4-Methoxyhomophenylalanine | 4-MeOhF |

Nomenclature and Symbolism for Amino Acids and Peptides by the UPAC-IUB Joint Commission on Biochemical Nomenclature (JCBN) have been published in the following documents: Biochem. J., 1984, 219, 345-373; Eur. J. Biochem., 1984, 138, 9-37; 1985, 152, 1; 1993, 213, 2; Internat. J. Pept. Prot. Res., 1984, 24, following p 84; J. Biol. Chem., 1985, 260, 14-42; Pure Appl. Chem., 1984, 56, 595-624; Amino Acids and Peptides, 1985, 16, 387-410; Biochemical Nomenclature and Related Documents, 2nd edition, Portland Press, 1992, pages 39-69.

The one or more useful modifications to peptide domains of the inventive compositions can include amino acid additions or insertions, amino acid deletions, peptide truncations, amino acid substitutions, and/or chemical derivatization of amino acid residues, accomplished by known chemical techniques. For example, the thusly modified amino acid sequence includes at least one amino acid residue inserted or substituted therein, relative to the amino acid sequence of the native sequence of interest, in which the inserted or substituted amino acid residue has a side chain comprising a nucleophilic or electrophilic reactive functional group by which the peptide is covalently conjugated to a linker and/or half-life extending moiety. In accordance with the invention, useful examples of such a nucleophilic or electrophilic reactive functional group include, but are not limited to, a thiol, a primary amine, a seleno, a hydrazide, an aldehyde, a carboxylic acid, a ketone, an aminooxy, a masked (protected) aldehyde, or a masked (protected) keto functional group. Examples of amino acid residues having a side chain comprising a nucleophilic reactive functional group include, but are not limited to, a lysine residue, a homolysine, an α,β-diaminopropionic acid residue, an α,γ-diaminobutyric acid residue, an ornithine residue, a cysteine, a homocysteine, a glutamic acid residue, an aspartic acid residue, or a selenocysteine ("SeCys" or "SeC") residue.

Amino acid residues are commonly categorized according to different chemical and/or physical characteristics. The term "acidic amino acid residue" refers to amino acid residues in D- or L-form having side chains comprising acidic groups. Exemplary acidic residues include aspartic acid and glutamic acid residues. The term "alkyl amino acid residue" refers to amino acid residues in D- or L-form having $C_1$-6alkyl side chains which may be linear, branched, or cyclized, including to the amino acid amine as in proline, wherein the $C_{1-6}$alkyl is substituted by 0, 1, 2 or 3 substituents selected from $C_{1-4}$haloalkyl, halo, cyano, nitro, —C(=O)$R^b$, —C(=O)O$R^a$, —C(=O)N$R^aR^a$, —C(=N$R^a$)N$R^aR^a$, —N$R^a$C(=N$R^a$)N$R^aR^a$, —O$R^a$, —OC(=O)$R^b$, —OC(=O)N$R^aR^a$, —O$C_{2-6}$alkylN$R^aR^a$, —O$C_{2-6}$alkylO$R^a$, —S$R^a$, —S(=O)$R^b$, —S(=O)$_2R^b$, —S(=O)$_2$N$R^aR^a$, —N$R^aR^a$, —N($R^a$)C(=O)$R^b$, —N($R^a$)C(=O)O$R^b$, —N($R^a$)C(=O)N$R^aR^a$, N($R^a$)C(=N$R^a$)N$R^aR^a$, —N($R^a$)S(=O)$_2R^b$, —N($R^a$)S(=O)$_2$N$R^aR^a$, —N$R^a$$C_{2-6}$alkylN$R^aR^a$ and —N$R^a$$C_{2-6}$alkylO$R^a$; wherein $R^a$ is independently, at each instance, H or $R^b$; and $R^b$ is independently, at each instance $C_{1-6}$alkyl substituted by 0, 1, 2 or 3 substituents selected from halo, $C_{1-4}$alk, $C_{1-3}$haloalk, —O$C_{1-4}$alk, —$NH_2$, —NH$C_{1-4}$alk, and —N($C_{1-4}$alk)$C_{1-4}$alk; or any protonated form thereof, including alanine, valine, leucine, isoleucine, proline, serine, threonine, lysine, arginine, histidine, aspartate, glutamate, asparagine, glutamine, cysteine, methionine, hydroxyproline, cyclohexylalanine, norleucine, norvaline, 2-aminobutyric acid, but which residues do not contain an aryl or aromatic group. The term "aromatic amino acid residue" refers to amino acid residues in D- or L-form having side chains comprising aromatic groups. Exemplary aromatic residues include tryptophan, tyrosine, 3-(1-naphthyl)alanine, histidine, or phenylalanine residues. The term "basic amino acid residue" refers to amino acid residues in D- or L-form having side chains comprising basic groups. Exemplary basic amino acid residues include histidine, lysine, homolysine, ornithine, arginine, N-methyl-arginine, ω-aminoarginine, ω-methyl-arginine, 1-methyl-histidine, 3-methyl-histidine, and homoarginine (hR) residues. The term "hydrophilic amino acid residue" refers to amino acid residues in D- or L-form having side chains comprising polar groups. Exemplary hydrophilic residues include cysteine, serine, threonine, histidine, lysine, asparagine, aspartate, glutamate, glutamine, and citrulline (Cit) residues. The terms "lipophilic amino acid residue" refers to amino acid residues in D- or L-form having sidechains comprising uncharged, aliphatic or aromatic groups. Exemplary lipophilic sidechains include phenylalanine, isoleucine, leucine, methionine, valine, tryptophan, and tyrosine. Alanine (A) is amphiphilic—it is capable of acting as a hydrophilic, or lipophilic (i.e., hydrophobic), residue. Alanine, therefore, is included within the definition of both "lipophilic" (i.e., "hydrophobic") residue and "hydrophilic" residue. The term "nonfunctional" or "neutral" amino acid residue refers to amino acid residues in D- or L-form having side chains that lack acidic, basic, or aromatic groups. Exemplary neutral amino acid residues include methionine, glycine, alanine, valine, isoleucine, leucine, and norleucine (Nle) residues.

Additional useful embodiments of toxin peptide analogs can result from conservative modifications of the amino acid sequences of the toxin polypeptides disclosed herein. Conservative modifications will produce half-life extending moiety-conjugated peptides having functional, physical, and chemical characteristics similar to those of the conjugated (e.g., PEG-conjugated) peptide from which such modifications are made. Such conservatively modified forms of the conjugated toxin peptide analogs disclosed herein are also contemplated as being an embodiment of the present invention.

In contrast, substantial modifications in the functional and/or chemical characteristics of peptides may be accomplished by selecting substitutions in the amino acid sequence that differ significantly in their effect on maintaining (a) the structure of the molecular backbone in the region of the substitution, for example, as an α-helical conformation, (b) the charge or hydrophobicity of the molecule at the target site, or (c) the size of the molecule.

For example, a "conservative amino acid substitution" may involve a substitution of a native amino acid residue with a nonnative residue such that there is little or no effect on the polarity or charge of the amino acid residue at that position. Furthermore, any native residue in the polypeptide may also be substituted with alanine, as has been previously described for "alanine scanning mutagenesis" (see, for example, MacLennan et al., Acta Physiol. Scand. Suppl., 643:55-67 (1998); Sasaki et al., 1998, Adv. Biophys. 35:1-24 (1998), which discuss alanine scanning mutagenesis).

In some useful embodiments of the compositions of the invention, the amino acid sequence of the toxin peptide is modified in one or more ways relative to a native toxin peptide sequence of interest, such as, but not limited to, a native JzTx-V sequence (SEQ ID NO:2), a peptide analog of JzTx-V, or any other toxin peptides having amino acid sequences as set forth in Table 5, or elsewhere herein. The one or more useful modifications can include amino acid additions or insertions, amino acid deletions, peptide truncations, amino acid substitutions, and/or chemical derivatization of amino acid residues, accomplished by known chemical techniques. Such modifications can be, for example, for the purpose of enhanced potency, selectivity, and/or proteolytic stability, or the like. Those skilled in the art are aware of techniques for designing peptide analogs with such enhanced properties, such as alanine scanning, rational design based on alignment mediated mutagenesis using known toxin peptide sequences and/or molecular modeling.

The term "protease" is synonymous with "peptidase". Proteases comprise two groups of enzymes: the endopeptidases which cleave peptide bonds at points within the protein, and the exopeptidases, which remove one or more amino acids from either N- or C-terminus respectively. The term "proteinase" is also used as a synonym for endopeptidase. The four mechanistic classes of proteinases are: serine proteinases, cysteine proteinases, aspartic proteinases, and metallo-proteinases. In addition to these four mechanistic classes, there is a section of the enzyme nomenclature which is allocated for proteases of unidentified catalytic mechanism. This indicates that the catalytic mechanism has not been identified.

Cleavage subsite nomenclature is commonly adopted from a scheme created by Schechter and Berger (Schechter I. & Berger A., On the size of the active site in proteases. I. Papain, Biochemical and Biophysical Research Communication, 27:157 (1967); Schechter I. & Berger A., On the active site of proteases. 3. Mapping the active site of papain; specific inhibitor peptides of papain, Biochemical and Biophysical Research Communication, 32:898 (1968)). According to this model, amino acid residues in a substrate undergoing cleavage are designated P1, P2, P3, P4 etc. in the N-terminal direction from the cleaved bond. Likewise, the residues in the C-terminal direction are designated P1', P2', P3', P4', etc.

The skilled artisan is aware of a variety of tools for identifying protease binding or protease cleavage sites of interest. For example, the PeptideCutter software tool is available through the ExPASy (Expert Protein Analysis System) proteomics server of the Swiss Institute of Bioinformatics (SIB; www.expasy.org/tools/peptidecutter). PeptideCutter searches a protein sequence from the SWISS-PROT and/or TrEMBL databases or a user-entered protein sequence for protease cleavage sites. Single proteases and chemicals, a selection or the whole list of proteases and chemicals can be used. Different forms of output of the results are available: tables of cleavage sites either grouped alphabetically according to enzyme names or sequentially according to the amino acid number. A third option for output is a map of cleavage sites. The sequence and the cleavage sites mapped onto it are grouped in blocks, the size of which can be chosen by the user. Other tools are also known for determining protease cleavage sites. (E.g., Turk, B. et al., Determination of protease cleavage site motifs using mixture-based oriented peptide libraries, Nature Biotechnology, 19:661-667 (2001); Barrett A. et al., Handbook of proteolytic enzymes, Academic Press (1998)).

The serine proteinases include the chymotrypsin family, which includes mammalian protease enzymes such as chymotrypsin, trypsin or elastase or kallikrein. The serine proteinases exhibit different substrate specificities, which are related to amino acid substitutions in the various enzyme subsites interacting with the substrate residues. Some enzymes have an extended interaction site with the substrate whereas others have a specificity restricted to the P1 substrate residue.

Trypsin preferentially cleaves at R or K in position P1. A statistical study carried out by Keil (1992) described the negative influences of residues surrounding the Arg- and Lys-bonds (i.e. the positions P2 and P1', respectively) during trypsin cleavage. (Keil, B., Specificity of proteolysis, Springer-Verlag Berlin-Heidelberg-NewYork, 335 (1992)). A proline residue in position P1' normally exerts a strong negative influence on trypsin cleavage. Similarly, the positioning of R and K in P1' results in an inhibition, as well as negatively charged residues in positions P2 and P1'.

Chymotrypsin preferentially cleaves at a W, Y or F in position P1 (high specificity) and to a lesser extent at L, M or H residue in position P1. (Keil, 1992). Exceptions to these rules are the following: When W is found in position P1, the cleavage is blocked when M or P are found in position P1' at the same time. Furthermore, a proline residue in position P1' nearly fully blocks the cleavage independent of the amino acids found in position P1. When an M residue is found in position P1, the cleavage is blocked by the presence of a Y residue in position P 1'. Finally, when H is located in position P1, the presence of a D, M or W residue also blocks the cleavage.

Membrane metallo-endopeptidase (NEP; neutral endopeptidase, kidney-brush-border neutral proteinase, enkephalinase, EC 3.4.24.11) cleaves peptides at the amino side of hydrophobic amino acid residues. (Connelly, J C et al., Neutral Endopeptidase 24.11 in Human Neutrophils: Cleavage of Chemotactic Peptide, PNAS, 82(24):8737-8741 (1985)).

Thrombin preferentially cleaves at an R residue in position P1. (Keil, 1992). The natural substrate of thrombin is fibrinogen. Optimum cleavage sites are when an R residue is in position P1 and Gly is in position P2 and position Pr. Likewise, when hydrophobic amino acid residues are found in position P4 and position P3, a proline residue in position P2, an R residue in position P1, and non-acidic amino acid residues in position P1' and position P2'. A very important residue for its natural substrate fibrinogen is a D residue in P10.

Caspases are a family of cysteine proteases bearing an active site with a conserved amino acid sequence and which cleave peptides specifically following D residues. (Earnshaw W C et al., Mammalian caspases: Structure, activation, substrates, and functions during apoptosis, Annual Review of Biochemistry, 68:383-424 (1999)).

The Arg-C proteinase preferentially cleaves at an R residue in position P1. The cleavage behavior seems to be only moderately affected by residues in position P1'. (Keil, 1992). The Asp-N endopeptidase cleaves specifically bonds with a D residue in position P F. (Keil, 1992).

The foregoing is merely exemplary and by no means an exhaustive treatment of knowledge available to the skilled artisan concerning protease binding and/or cleavage sites that the skilled artisan may be interested in eliminating in practicing the invention.

Desired amino acid substitutions (whether conservative or non-conservative) can be determined by those skilled in the art at the time such substitutions are desired. For example, amino acid substitutions can be used to identify important residues of the peptide sequence, or to increase or decrease the affinity of the peptide or vehicle-conjugated peptide molecules described herein.

Naturally occurring residues may be divided into classes based on common side chain properties:

1) hydrophobic: norleucine (Nor or Nle), Met, Ala, Val, Leu, Ile;

2) neutral hydrophilic: Cys, Ser, Thr, Asn, Gln;

3) acidic: Asp, Glu;

4) basic: His, Lys, Arg;

5) residues that influence chain orientation: Gly, Pro; and 6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of these classes for a member from another class. Such substituted residues may be introduced into regions of the toxin peptide analog.

In making such changes, according to certain embodiments, the hydropathic index of amino acids may be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art (see, for example, Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those that are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as disclosed herein. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those that are within ±1 are included, and in certain embodiments, those within ±0.5 are included. One may also identify epitopes from primary amino acid sequences on the basis of hydrophilicity. These regions are also referred to as "epitopic core regions."

Examples of conservative substitutions include the substitution of one non-polar (hydrophobic) amino acid residue such as isoleucine, valine, leucine norleucine, alanine, or methionine for another, the substitution of one polar (hydrophilic) amino acid residue for another such as between arginine and lysine, between glutamine and asparagine, between glycine and serine, the substitution of one basic amino acid residue such as lysine, arginine or histidine for another, or the substitution of one acidic residue, such as aspartic acid or glutamic acid for another. The phrase "conservative amino acid substitution" also includes the use of a chemically derivatized residue in place of a non-derivatized residue, provided that such polypeptide displays the requisite bioactivity. Other exemplary amino acid substitutions that can be useful in accordance with the present invention are set forth in Table 4 below.

TABLE 4

Some Useful Amino Acid Substitutions.

| Original Residues | Exemplary Substitutions |
|---|---|
| Ala | Val, Leu, Ile, Gly |
| Arg | Lys, Gln, Asn, His |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala, Phe, Norleucine |
| Leu | Norleucine, Ile, Val, Met, Ala, Phe |
| Lys | Arg, 1,4-Diamino-butyric Acid, Gln, Asn, His |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala, Norleucine |

By way of illustration, some embodiments of the present invention are directed to a composition of matter comprising an isolated polypeptide comprising the amino acid sequence of the formula:

$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}$
$X_{aa}^{11}Asp^{12}X_{aa}^{13}X_{aa}^{14}X_{aa}^{15}X_{aa}^{16}X_{aa}^{17}$
$X_{aa}^{18}X_{aa}^{19}X_{aa}^{20}Leu^{21}X_{aa}^{22}X_{aa}^{23}X_{aa}^{24}$
$X_{aa}^{25}X_{aa}^{26}X_{aa}^{27}X_{aa}^{28}X_{aa}^{29}X_{aa}^{30}X_{aa}^{31}$
$X_{aa}^{32}X_{aa}^{33}X_{aa}^{34}$// SEQ ID NO:590 or a pharmaceutically acceptable salt thereof, wherein:

$X_{aa}^{1}X_{aa}^{2}$ is absent; or $X_{aa}^{1}$ is any amino acid residue (e.g., but not limited to, Pra, Aha, Abu, Nva, Nle, Sar, hLeu, hPhe, D-Leu, D-Phe, D-Ala, bAla, AllylG, CyA, or Atz residue or any canonical amino acid residue) and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent. (For example, $X_{aa}^{1}$ is absent; or $X_{aa}^{1}$ is any amino acid residue; and $X_{aa}^{2}$ is any hydrophobic or acidic amino acid residue, or a Pra, hPra, bhPra, ethynylphenylalanine (EPA), (S)-2-amino-4-hexynoic acid, Aha, Abu, Nva, Nle, Sar, hLeu, hPhe, D-Leu, D-Phe, D-Ala, bAla, AllylG, CyA, or Atz residue, or any canonical amino acid residue);

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic (e.g., histidine, lysine, citrulline, homolysine, ornithine, arginine, N-methyl-arginine, ω-aminoarginine, ω-methyl-arginine, 1-methyl-histidine, 3-methyl-histidine, or homoarginine) or a neutral hydrophilic amino acid residue;

$X_{aa}^{7}$ is a Trp, 5-bromoTrp, 6-bromoTrp, 5-chloroTrp, 6-chloroTrp, 1-Nal, 2-Nal, thioTrp, BhPhe, 2-BrhF, 2-ClhF, 2-FhF, 2-MehF, 2-MeOhF, 3-BrhF, 3-ClhF, 3-FhF, 3-MehF, 3-MeOhF, 4-BrhF, 4-ClhF, 4-FhF, 4-Me-F, 4-MehF, 4-MeOhF residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue;

$X_{aa}^{14}$ is a basic or acidic residue or an Ala residue;

$X_{aa}^{15}$ is an Arg or Cit residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly, Asp or Ala residue;

$X_{aa}^{22}$ is an acidic, basic, or neutral hydrophilic amino acid residue, or Ala or Val residue;

$X_{aa}^{23}$ is a Cys or SeCys residue;

$X_{aa}^{24}$ is a basic or neutral hydrophilic amino acid or Ala residue;

$X_{aa}^{25}$ is an aliphatic hydrophobic residue;

$X_{aa}^{26}$ is a Trp, 5-bromoTrp, 6-bromoTrp, 5-chloroTrp, 6-chloroTrp, 7BrW, 1-Nal, 2-Nal, thioTrp, 5-phenylTrp, 5-iPrTrp, 5-ethylTrp, or 5-MeTrp residue;

$X_{aa}^{27}$ is a Cys or SeCys residue;

$X_{aa}^{28}$ is a basic (e.g., Cit, histidine, lysine, citrulline, homolysine, ornithine, arginine, N-methyl-arginine, ω-aminoarginine, ω-methyl-arginine, 1-methyl-histidine, 3-methyl-histidine, or homoarginine) or neutral hydrophilic amino acid residue;

$X_{aa}^{29}$ is a basic amino acid residue, or a Tyr or Leu residue;

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue, if $X_{aa}^{22}$ is an acidic amino acid residue (e.g., Glu, Asp, phosphoserine, phosphotyrosine, or gamma-carboxyglutamic acid residue); or $X_{aa}^{30}$ is an acidic amino acid residue or a Pro residue, if $X_{aa}^{22}$ is a basic or neutral hydrophilic amino acid residue or an Ala or Val residue (for example, if $X_{aa}^{22}$ is selected from histidine, lysine, citrulline, homolysine, ornithine, arginine, N-methyl-arginine, w-aminoarginine, ω-methyl-arginine, 1-methyl-histidine, 3-methyl-histidine, homoarginine, Ala or Val residues, then $X_{aa}^{30}$ can be selected from Glu, Asp, phosphoserine, phosphotyrosine, and gamma-carboxyglutamic acid residues or a Pro residue);

$X_{aa}^{31}$ is an Ile, Trp, Phe, BhPhe, Cha, Tyr, 5-bromoTrp, 6-bromoTrp, 5-chloroTrp, 6-chloroTrp, 1-Nal, 2-Nal, thioTrp, or 4-tBuF residue;

each of $X_{aa}^{32}$, $X_{aa}^{33}$, and $X_{aa}^{34}$ is independently absent or is independently a hydrophobic or acidic amino acid residue, or a Ser or Gly residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

Particularly useful embodiments include those in which one or more (i.e., one, two, or three) of $X_{aa}^{14}$, $X_{aa}^{16}$, or $X_{aa}^{22}$ of SEQ ID NO:590 is an acidic amino acid residue (e.g., a Glu, Asp, phosphoserine, phosphotyrosine, or gamma-carboxyglutamic acid residue), such as combinations of Glu at both $X_{aa}^{14}$ and $X_{aa}^{16}$ of SEQ ID NO:590.

By way of further illustration, some embodiments of the present invention are directed to a composition of matter comprising an isolated polypeptide comprising the amino acid sequence of the formula:

$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}$
$X_{aa}^{11}Asp^{12}X_{aa}^{13}X_{aa}^{14}Arg^{15}X_{aa}^{16}X_{aa}^{17}$
$X_{aa}^{18}X_{aa}^{19}X_{aa}^{20}Leu^{21}X_{aa}^{22}X_{aa}^{23}X_{aa}^{24}$
$Leu^{25}X_{aa}^{26}X_{aa}^{27}X_{aa}^{28}X_{aa}^{29}X_{aa}^{30}X_{aa}^{31}$
$X_{aa}^{32}X_{aa}^{33}X_{aa}^{34}$// SEQ ID NO:516 or a pharmaceutically acceptable salt thereof,
wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent (e.g., if present, $X_{aa}^{1}$ or $X_{aa}^{2}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, Dab, Dap, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{3}$ is any amino acid residue (e.g., $X_{aa}^{3}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-s-methyl lysine, Dab, Dap, norleucine, norvaline, 1-Nal, 2-Nal, cyclohexylglycine (Chg), cyclohexylalanine (Cha), and 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic (e.g., $X_{aa}^{5}$ is a Gln, Asn, Ser, Thr, or Cit residue) or basic (e.g., $X_{aa}^{5}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) amino acid residue;

$X_{aa}^{6}$ is any basic amino acid residue (e.g., $X_{aa}^{6}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic (e.g., $X_{aa}^{10}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or neutral hydrophilic (e.g., $X_{aa}^{10}$ is a Gln, Asn, Ser, Thr, or Cit residue) amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue (e.g., $X_{aa}^{13}$ can be selected from Asp, Glu, His, Lys, Asn, Pro, Gln, Arg, Ser, Thr, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, Dap, norleucine, norvaline, Pra, Aha, AzK, Abu, Nva, Nle Sar, hLeu, hPhe, D-Leu, D-Phe, D-Ala, bAla, AllylG, CyA, and Atz residues);

$X_{aa}^{14}$ is a basic residue (e.g., $X_{aa}^{14}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or an Ala residue;

$X_{aa}^{16}$ is any amino acid residue (e.g., $X_{aa}^{16}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, Dab, Dap, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue (e.g., $X_{aa}^{19}$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, Dab, Dap, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{20}$ is a Gly or Ala residue;

$X_{aa}^{22}$ is an acidic (e.g., $X_{aa}^{22}$ is a Glu, Asp, phosphoserine, phosphotyrosine, or gamma-carboxyglutamic acid residue), basic amino acid residue (e.g., $X_{aa}^{22}$ is a histidine, lysine, homolysine, ornithine, Dab, Dap, arginine, N-methyl-arginine, w-aminoarginine, ω-methyl-arginine, 1-methyl-histidine, 3-methyl-histidine, or homoarginine residue), or Ala residue;

$X_{aa}^{23}$ is a Cys or SeCys residue;

$X_{aa}^{24}$ is a basic amino acid (e.g., $X_{aa}^{24}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue (e.g., $X_{aa}^{28}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{29}$ is a basic amino acid residue (e.g., $X_{aa}^{29}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue, if $X_{aa}^{22}$ is an acidic amino acid residue; or $X_{aa}^{30}$ is an acidic amino acid residue (e.g., $X_{aa}^{30}$ is a Glu, Asp, phosphoserine, phosphotyrosine, or gamma-carboxy-glutamic acid residue), if $X_{aa}^{22}$ is a basic amino acid residue or an Ala residue;

$X_{aa}^{31}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

each of $X_{aa}^{32}$, $X_{aa}^{33}$, and $X_{aa}^{34}$ is independently absent or is independently a hydrophobic amino acid residue (e.g., Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chlorophenylalanine, 3,4-dichlorophenylalanine, 4-trifluoromethyl-phenylalanine, and 4-phenyl-phenylalanine (Bip) residues);

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{n}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated. Carboxy-terminally amidated embodiments are among particularly useful ones for therapeutic use. Many examples of such C-terminally amidated peptide analogs appear in Table 5.

In some useful embodiments, (i) $X_{aa}^{1}$ is a Pra, Aha, AzK, thiaproline, Abu, Nva, Nle Sar, hLeu, hPhe, D-Leu, D-Phe, D-Ala, bAla, AllylG, CyA, or Atz residue, and $X_{aa}^{2}$ is any amino acid residue (e.g., $X_{aa}^{2}$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, Abu, Nva, Nle Sar, hLeu, hPhe, D-Leu, D-Phe, D-Ala, bAla, AllylG, CyA, and Atz residues); or (ii) $X_{aa}^{1}$ is absent and $X_{aa}^{2}$ is a Pra, Aha, AzK, thiaproline, Abu, Nva, Nle, Sar, hLeu, hPhe, D-Leu, D-Phe, D-Ala, bAla, AllylG, CyA, or Atz residue.

In other embodiments, (i) $X_{aa}^{1}$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), and 4-phenyl-phenylalanine (Bip) residues, and $X_{aa}^{2}$ is any amino acid residue (e.g., Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), or 4-phenyl-phenylalanine (Bip) residue); or (ii) $X_{aa}^{1}$ is absent and $X_{aa}^{2}$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), and 4-phenyl-phenylalanine (Bip) residues.

Any of the above-described examples of amino acid residues at the positions of SEQ ID NO:516 can also apply to the analogous positions of SEQ ID NO:590.

Another example of an inventive composition of the present invention is the composition of matter wherein the isolated polypeptide comprises the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}Asp^{12}X_{aa}^{13}X_{aa}^{14}Arg^{15}X_{aa}^{16}X_{aa}^{17}X_{aa}^{18}X_{aa}^{19}X_{aa}^{20}Leu^{21}X_{aa}^{22}X_{aa}^{23}X_{aa}^{24}Leu^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}//$$

SEQ ID NO:517 or a pharmaceutically acceptable salt thereof, wherein:

$X_{aa}^{1}$ is absent; or $X_{aa}^{1}$ is any amino acid residue (e.g., $X_{aa}^{1}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, Dap, norleucine, norvaline, 1-Nal, 2-Nal, cyclohexylglycine (Chg), cyclohexylalanine (Cha), and 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{2}$ is any hydrophobic amino acid residue, or a Pra, Aha, Abu, Nva, Nle, Sar, hLeu, hPhe, D-Leu, D-Phe, D-Ala, bAla, AllylG, CyA, or Atz residue;

$X_{aa}^{3}$ is any amino acid residue (e.g., $X_{aa}^{3}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, Dap, norleucine, norvaline, 1-Nal, 2-Nal, cyclohexylglycine (Chg), cyclohexylalanine (Cha), and 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic (e.g., $X_{aa}^{5}$ is a Gln, Asn, Ser, Thr, or Cit residue) or basic (e.g., $X_{aa}^{5}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) amino acid residue;

$X_{aa}^{6}$ is any basic amino acid residue (e.g., $X_{aa}^{6}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Leu or Nle residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic (e.g., $X_{aa}^{10}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or neutral hydrophilic (e.g., $X_{aa}^{10}$ is a Gln, Asn, Ser, Thr, or Cit residue) amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue (e.g., $X_{aa}^{13}$ can be selected from Asp, Glu, His, Lys, Asn, Pro, Gln, Arg, Ser, Thr, phosphoserine, phosphotyrosine, or gamma-carboxyglutamic acid, homolysine, ornithine, N-methyl-arginine, w-aminoarginine, ω-methyl-arginine, 1-methyl-histidine, 3-methyl-histidine, homoarginine, N-methyl-lysine, N-ε-methyl lysine, Dab, Dap, norleucine, norvaline, Pra, Aha, AzK, Abu, Nva, Nle Sar, hLeu, hPhe, D-Leu, D-Phe, D-Ala, bAla, AllylG, CyA, and Atz residues);

$X_{aa}^{14}$ is a basic residue (e.g., $X_{aa}^{14}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or an Ala residue;

$X_{aa}^{16}$ is any amino acid residue (e.g., $X_{aa}^{16}$ can be selected from Ala, Asp, Cys, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, Dab, Dap, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue (e.g., $X_{aa}^{19}$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, Dab, Dap, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), 4-phenyl-phenylalanine (Bip), Pra, Aha, AzK, Abu, Nva, Nle Sar, hLeu, hPhe, D-Leu, D-Phe, D-Ala, bAla, AllylG, CyA, and Atz residues);

$X_{aa}^{20}$ is a Gly or Ala residue;

$X_{aa}^{22}$ is a basic amino acid residue (e.g., $X_{aa}^{22}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or an Ala residue;

$X_{aa}^{23}$ is a Cys or SeCys residue;

$X_{aa}^{24}$ is a basic amino acid residue (e.g., $X_{aa}^{24}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue) or an Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue (e.g., $X_{aa}^{28}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{29}$ is a basic amino acid residue (e.g., $X_{aa}^{29}$ is a histidine, lysine, homolysine, ornithine, Dab, Dap, arginine, N-methyl-arginine, ω-aminoarginine, ω-methyl-arginine, 1-methyl-histidine, 3-methyl-histidine, or homoarginine residue);

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

$X_{aa}^{31}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

each of $X_{aa}^{32}$, $X_{aa}^{33}$, and $X_{aa}^{34}$ is independently absent or is independently a hydrophobic amino acid residue (e.g., Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chlorophenylalanine, 3,4-dichlorophenylalanine, 4-trifluoromethyl-phenylalanine, and 4-phenyl-phenylalanine (Bip) residues);

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated. Carboxy-terminally amidated embodiments are among particularly useful ones for therapeutic use. Many examples of such C-terminally amidated peptide analogs appear in Table 5.

In some useful embodiments, $X_{aa}^{2}$ is a Pra, Aha, Abu, Nva, Nle, Sar, hLeu, hPhe, D-Leu, D-Phe, D-Ala, bAla, AllylG, CyA, Atz, Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, or 4-phenyl-phenylalanine (Bip) residue.

In other useful embodiments, (i) $X_{aa}^1$ is a Pra, Aha, Abu, Nva, Nle Sar, hLeu, hPhe, D-Leu, D-Phe, D-Ala, bAla, AllylG, CyA, or Atz residue, and $X_{aa}^2$ is any hydrophobic amino acid residue (e.g., $X_{aa}^2$ can be selected from Phe, Ile, Leu, Met, Val, Trp, Tyr, thiaproline, norleucine, norvaline, 1-Nal, 2-Nal, cyclohexylglycine (Chg), cyclohexylalanine (Cha), and 4-phenyl-phenylalanine (Bip)), or a Pra, Aha, Abu, Nva, Nle, Sar, hLeu, hPhe, D-Leu, D-Phe, D-Ala, bAla, AllylG, CyA, and Atz residue; or (ii) $X_{aa}^1$ is absent and $X_{aa}^2$ is a Pra, Aha, AzK, thiaproline, Abu, Nva, Nle, Sar, hLeu, hPhe, D-Leu, D-Phe, D-Ala, bAla, AllylG, CyA, or Atz residue.

In other embodiments, (i) $X_{aa}^1$ can be selected from Ala, Asp, Glu, Phe, Gly, His, Ile, Lys, Leu, Met, Asn, Pro, Gln, Arg, Ser, Thr, Val, Trp, Tyr, thiaproline, phosphoserine, phosphotyrosine, or gamma-carboxyglutamic acid, homolysine, ornithine, N-methyl-arginine, ω-aminoarginine, ω-methyl-arginine, 1-methyl-histidine, 3-methyl-histidine, homoarginine, N-methyl-lysine, N-ε-methyl lysine, Dab, norleucine, norvaline, 1-Nal, 2-Nal, cyclohexylglycine (Chg), cyclohexylalanine (Cha), and 4-phenyl-phenylalanine (Bip) residues, and $X_{aa}^2$ is any hydrophobic amino acid residue (e.g., Phe, Ile, Leu, Met, Val, Trp, Tyr, thiaproline, norleucine, norvaline, 1-Nal, 2-Nal, cyclohexylglycine (Chg), cyclohexylalanine (Cha), or 4-phenyl-phenylalanine (Bip) residue) or a Pra, Aha, Abu, Nva, Nle, Sar, hLeu, hPhe, D-Leu, D-Phe, D-Ala, bAla, AllylG, CyA, or Atz residue; or (ii) $X_{aa}^1$ is absent and $X_{aa}^2$ can be selected from Phe, Ile, Leu, Met, Val, Trp, Tyr, thiaproline, norleucine, norvaline, 1-Nal, 2-Nal, cyclohexylglycine (Chg), cyclohexylalanine (Cha), and 4-phenyl-phenylalanine (Bip) residues.

Any of the above-described examples of amino acid residues at the positions of SEQ ID NO:517 can also apply to the analogous positions of SEQ ID NO:590.

Other exemplary embodiments of the inventive composition are unconjugated or conjugated peptide analogs of JzTx-V having one of the amino acid sequences as set forth in Table 5. Particular embodiments of the inventive isolated polypeptides that can either be unconjugated or conjugated, include those having an amino acid sequence selected from SEQ ID NOS: 63, 69, 110-115, 131, 137, 139-147, 149-150, 152-154, 157, 159-172, 174-175, 177-179, 182, 184-246, 273-274, 277, 279, 284-295, 297-356, 392-397, 406-409, 411-422, 426, 435-437, 439-445, 447-452, 455-475, 518, 520, 521, 523, 524, 526, 527, 546-563, 565-566, 568, 573, 574, 576, 577, 578-588, SEQ ID NO:597, SEQ ID NO:605, SEQ ID NO:614, SEQ ID NO:615, SEQ ID NO:635, SEQ ID NO:636, SEQ ID NO:640, SEQ ID NO:641, SEQ ID NO:642, SEQ ID NO:643, SEQ ID NO:644, SEQ ID NO:645, SEQ ID NO:657, SEQ ID NO:667, SEQ ID NO:687, SEQ ID NO:688, SEQ ID NOS: 692-697, SEQ ID NO:701, SEQ ID NO:702, SEQ ID NO:707, SEQ ID NO:708, SEQ ID NO:709, SEQ ID NOS: 714-718, SEQ ID NO:721, SEQ ID NO:723, SEQ ID NOS: 726-729, SEQ ID NOS: 731-757, SEQ ID NOS: 764-785, SEQ ID NO:789, SEQ ID NO:790, SEQ ID NO:791, SEQ ID NOS: 795-801, SEQ ID NO:803, SEQ ID NO:804, SEQ ID NO:805, SEQ ID NO:807, SEQ ID NO:808, SEQ ID NO:809, SEQ ID NO:814, SEQ ID NOS: 816-824, SEQ ID NO:828, SEQ ID NO:829, SEQ ID NO:831, SEQ ID NO:833, SEQ ID NOS: 835-870, SEQ ID NOS: 873-885, SEQ ID NOS: 888-909, SEQ ID NO:911, SEQ ID NO:912, SEQ ID NO:913, SEQ ID NO:923, SEQ ID NO:924, SEQ ID NO:925, SEQ ID NO:929, SEQ ID NO:930, SEQ ID NO:931, SEQ ID NOS: 941-984, SEQ ID NOS: 986-1033, SEQ ID NOS: 1136-1188, SEQ ID NOS: 1190-1242, SEQ ID NO:1350, SEQ ID NO:1351, SEQ ID NO:1352, SEQ ID NO:1353, SEQ ID NOS: 1358-1369, SEQ ID NOS: 1382-1393, SEQ ID NOS: 1406-1417, SEQ ID NO:1430, SEQ ID NOS: 1432-1443, SEQ ID NOS: 1456-1467, SEQ ID NOS: 1480-1491, SEQ ID NOS: 1510-1515, SEQ ID NOS: 1522-1527, SEQ ID NOS: 1534-1611, SEQ ID NO:1613, SEQ ID NOS: 1615-1640, SEQ ID NO:1644, SEQ ID NO:1645, and SEQ ID NOS: 1649-1694, as set forth in Table 5; or comprises an amino acid sequence selected from SEQ ID NOS: 63, 69, 112-113, 115, 131, 137, 193-196, 200-203, 207-210, 214-217, 221-224, 228-231, 235-238, 242-246, 277, and 279, as set forth in Table 5, that does not include a non-canonical amino acid.

Some embodiments that can either be unconjugated or conjugated comprise useful combinations of mutations to the native JzTx-V amino acid sequence, e.g, Glu residues at $Xaa^{14}$ and $Xaa^{30}$ of SEQ ID NO:590, such as SEQ ID NOS: 715, 728, 732, 735, 737, 742, 744, 746, 747, 748, 749, 753, 754, 755, 756, 757, 835, 836, 837, 953, 954, 955, 956, 957, 969, 970, 971, 972, 973, 974, 975, 976, 977, 978, 979, 980, 981, 982, 983, 984, 1002, 1003, 1004, 1005, 1006, 1018, 1019, 1020, 1021, 1022, 1023, 1024, 1025, 1026, 1027, 1028, 1029, 1030, 1031, 1032, 1137, 1157, 1158, 1159, 1160, 1161, 1173, 1174, 1175, 1176, 1177, 1178, 1179, 1180, 1181, 1182, 1183, 1184, 1185, 1186, 1187, 1188, 1191, 1211, 1212, 1213, 1214, 1225, 1227, 1228, 1229, 1230, 1231, 1232, 1233, 1234, 1235, 1236, 1237, 1238, 1239, 1240, 1241, 1242, 1351, 1353, 1360, 1362, 1363, 1366, 1368, 1369, 1384, 1386, 1387, 1390, 1392, 1393, 1408, 1410, 1411, 1414, 1416, 1417, 1434, 1436, 1437, 1440, 1442, 1443, 1458, 1460, 1461, 1464, 1466, 1467, 1482, 1484, 1485, 1488, 1490, 1491, 1628, 1629, 1673, 1674, 1677, 1678, 1683, 1686, or 1687, as set forth in Table 5.

Other examples that can either be unconjugated or conjugated include Glu residues at $Xaa^{16}$ and $Xaa^{30}$ of SEQ ID NO:590, such as SEQ ID NOS: 717, 733,738, 740, 743, 745, 747, 749, 750, 751, 752, 753, 755, 756, 757, 770, 771, 773, 958, 959, 960, 961, 962, 963, 1138, 1162, 1163, 1164, 1165, 1166, 1167, 1192, 1361, 1367, 1385, 1391, 1409, 1415, 1430, 1435, 1441, 1459, 1465, 1483, 1489, 1596, 1597, 1598, 1600, 1602, 1645, or 1694, as set forth in Table 5.

Still other examples that can either be unconjugated or conjugated include Glu residues at $Xaa^{14}$ and $Xaa^{30}$ and a 5-BrTrp residue at $X_{aa}^{26}$ of SEQ ID NO:590, such as SEQ ID NOS: 1137, 1157, 1158, 1159, 1160, 1161, 1173, 1174, 1175, 1176, 1177, 1178, 1179, 1180, 1181, 1182, 1183, 1184, 1185, 1186, 1187, 1188, 1191, 1211, 1212, 1213, 1214, 1215, 1227, 1228, 1229, 1230, 1231, 1232, 1233, 1234, 1235, 1236, 1237, 1238, 1239, 1240, 1241, 1242, 1351, 1353, 1360, 1362, 1363, 1366, 1368, 1369, 1384, 1386, 1387, 1390, 1392, 1393, 1408, 1410, 1411, 1414, 1416, 1417, 1434, 1436, 1437, 1440, 1442, 1443, 1458, 1460, 1461, 1464, 1466, 1467, 1482, 1484, 1485, 1488, 1490, 1491, or 1629, as set forth in Table 5.

Additional examples that can either be unconjugated or conjugated include Glu residues at $Xaa^{16}$ and $Xaa^{30}$ and a 5-BrTrp residue at $X_{aa}^{26}$ of SEQ ID NO:590, such as SEQ ID NOS: 1138, 1162, 1163, 1164, 1165, 1166, 1167, 1192, 1361, 1367, 1385, 1391, 1409, 1415, 1430, 1435, 1441, 1459, 1465, 1483, or 1489, as set forth in Table 5.

In other embodiments that can either be unconjugated or conjugated, the composition of matter comprises an amino acid sequence selected from SEQ ID NOS: 247, 296, 358, 360, 361, 363-370, 372-391, 398-405, 410, 423-425, 427, 431-434, 438, 446, 453, 454, 571, 579-587, and 588, as set forth in Table 5.

Any of the above-described sequences further comprising an optional linker moiety and a pharmaceutically acceptable, covalently linked half-life extending moiety, as described herein, are also encompassed within the present invention. A pharmaceutical composition comprising any of these polypeptides (with or without a covalently linked half-life extending moiety) and a pharmaceutically acceptable carrier is also encompassed within the present invention.

TABLE 5

Amino acid sequences of JzTx-V and JzTx-V peptide analogs.

| SEQ ID NO. | Designation | Amino Acid Sequence |
|---|---|---|
| 1 | JzTx-V(1-29)-FreeAcid | {H}-YCQKWMWTCDSKRACCE GLRCKLWCRKII-{FreeAcid} |
| 2 | JzTx-V(1-29) | {H]-YCQKWMWTCDSKRACCE GLRCKLWCRKII-{Amide} |
| 3 | [Ala1]JzTx-V(1-29) | {H}-ACQKWMWTCDSKRACCE GLRCKLWCRKII-{Amide} |
| 4 | [Ala3]JzTx-V(1-29) | {H}-YCAKWMWTCDSKRACCE GLRCKLWCRKII-{Amide} |
| 5 | [Ala4]JzTx-V(1-29) | {H}-YCQAWMWTCDSKRACCE GLRCKLWCRKII-{Amide} |
| 6 | [Ala5]JzTx-V(1-29) | {H}-YCQKAMWTCDSKRACCE GLRCKLWCRKII-{Amide} |
| 7 | [Ala6]JzTx-V(1-29) | {H}-YCQKWAWTCDSKRACCE GLRCKLWCRKII-{Amide} |
| 8 | [Ala7]JzTx-V(1-29) | {H}-YCQKWMATCDSKRACCE GLRCKLWCRKII-{Amide} |
| 9 | [Ala8]JzTx-V(1-29) | {H}-YCQKWMWACDSKRACCE GLRCKLWCRKII-{Amide} |
| 10 | [Ala10]JzTx-V(1-29) | {H}-YCQKWMWTCASKRACCE GLRCKLWCRKII-{Amide} |
| 11 | [Ala11]JzTx-V(1-29) | {H}-YCQKWMWTCDAKRACCE GLRCKLWCRKII-{Amide} |
| 12 | [Ala12]JzTx-V(1-29) | {H}-YCQKWMWTCDSARACCE GLRCKLWCRKII-{Amide} |
| 13 | [Ala13]JzTx-V(1-29) | {H}-YCQKWMWTCDSKAACCE GLRCKLWCRKII-{Amide} |
| 14 | [Ala17]JzTx-V(1-29) | {H}-YCQKWMWTCDSKRACCA GLRCKLWCRKII-{Amide} |
| 15 | [Ala18]JzTx-V(1-29) | {H}-YCQKWMWTCDSKRACCE ALRCKLWCRKII-{Amide} |
| 16 | [Ala19]JzTx-V(1-29) | {H}-YCQKWMWTCDSKRACCE GARCKLWCRKII-{Amide} |
| 17 | [Ala20]JzTx-V(1-29) | {H}-YCQKWMWTCDSKRACCE GLACKLWCRKII-{Amide} |
| 18 | [Ala22]JzTx-V(1-29) | {H}-YCQKWMWTCDSKRACCE GLRCALWCRKII-{Amide} |
| 19 | [Ala23]JzTx-V(1-29) | {H}-YCQKWMWTCDSKRACCE GLRCKAWCRKII-{Amide} |
| 20 | [Ala24]JzTx-V(1-29) | {H}-YCQKWMWTCDSKRACCE GLRCKLACRKII-{Amide} |
| 21 | [Ala26]JzTx-V(1-29) | {H}-YCQKWMWTCDSKRACCE GLRCKLWCAKII-{Amide} |
| 22 | [Ala27]JzTx-V(1-29) | {H}-YCQKWMWTCDSKRACCE GLRCKLWCRAII-{Amide} |

TABLE 5-continued

Amino acid sequences of JzTx-V and JzTx-V peptide analogs.

| SEQ ID NO. | Designation | Amino Acid Sequence |
| --- | --- | --- |
| 23 | [Ala28]JzTx-V(1-29) | {H}-YCQKWMWTCDSKRACCE GLRCKLWCRKAI-{Amide} |
| 24 | [Ala29]JzTx-V(1-29) | {H}-YCQKWMWTCDSKRACCE GLRCKLWCRKIA-{Amide} |
| 25 | [1-Nal1]JzTx-V(1-29) | {H}-[1-Nal]CQKWMWTCDS KRACCEGLRCKLWCRKII- {Amide} |
| 26 | [1-Nal3]JzTx-V(1-29) | {H}-YC[1-Nal]KWMWTCDS KRACCEGLRCKLWCRKII- {Amide} |
| 27 | [1-Nal4]JzTx-V(1-29) | {H}-YCQ[1-Nal]WMWTCDS KRACCEGLRCKLWCRKII- {Amide} |
| 28 | [1-Nal5]JzTx-V(1-29) | {H}-YCQK[1-Nal]MWTCDS KRACCEGLRCKLWCRKII- {Amide} |
| 29 | [1-Nal6]JzTx-V(1-29) | {H}-YCQKW[1-Nal]WTCDS KRACCEGLRCKLWCRKII- {Amide} |
| 30 | [1-Nal7]JzTx-V(1-29) | {H}-YCQKWM[1-Nal]TCDS KRACCEGLRCKLWCRKII- {Amide} |
| 31 | [1-Nal8]JzTx-V(1-29) | {H}-YCQKWMW[1-Nal]CDS KRACCEGLRCKLWCRKII- {Amide} |
| 32 | [1-Nal10]JzTx-V(1-29) | {H}-YCQKWMWC[1-Nal]DS KRACCEGLRCKLWCRKII- {Amide} |
| 33 | [1-Nal11]JzTx-V(1-29) | {H}-YCQKWMWCD[1-Nal]S KRACCEGLRCKLWCRKII- {Amide} |
| 34 | [1-Nal12]JzTx-V(1-29) | {H}-YCQKWMWCDS[1-Nal] KRACCEGLRCKLWCRKII- {Amide} |
| 35 | [1-Nal13]JzTx-V(1-29) | {H}-YCQKWMWCDSK [1-Nal]RACCEGLRCKLWCR KII-{Amide} |
| 36 | [1-Nal14]JzTx-V(1-29) | {H}-YCQKWMWCDSKR [1-Nal]ACCEGLRCKLWCRK II-{Amide} |
| 37 | [1-Nal17]JzTx-V(1-29) | {H}-YCQKWMWCDSKRACC [1-Nal]EGLRCKLWCRKII- {Amide} |
| 38 | [1-Nal18]JzTx-V(1-29) | {H}-YCQKWMWCDSKRACCE [1-Nal]GLRCKLWCRKII- {Amide} |
| 39 | [1-Nal19]JzTx-V(1-29) | {H}-YCQKWMWCDSKRACCEG [1-Nal]LRCKLWCRKII- {Amide} |
| 40 | [1-Nal20]JzTx-V(1-29) | {H}-YCQKWMWCDSKRACCEG L[1-Nal]RCKLWCRKII- {Amide} |
| 41 | [1-Nal22]JzTx-V(1-29) | {H}-YCQKWMWCDSKRACCEG LRC[1-Nal]KLWCRKII- {Amide} |

TABLE 5-continued

Amino acid sequences of JzTx-V and JzTx-V peptide analogs.

| SEQ ID NO. | Designation | Amino Acid Sequence |
|---|---|---|
| 42 | [1-Nal23]JzTx-V(1-29) | {H}-YCQKWMWCDSKRACCEG LRCK[1-Nal]LWCRKII-{Amide} |
| 43 | [1-Nal24]JzTx-V(1-29) | {H}-YCQKWMWCDSKRACCEG LRCKL[1-Nal]CRKII-{Amide} |
| 44 | [1-Nal26]JzTx-V(1-29) | {H}-YCQKWMWCDSKRACCEG LRCKLWC[1-Nal]KII-{Amide} |
| 45 | [1-Nal27]JzTx-V(1-29) | {H}-YCQKWMWCDSKRACCEG LRCKLWCR[1-Nal]II-{Amide} |
| 46 | [1-Nal28]JzTx-V(1-29) | {H}-YCQKWMWCDSKRACCEG LRCKLWCRK[1-Nal]I-{Amide} |
| 47 | [1-Nal29]JzTx-V(1-29) | {H}-YCQKWMWCDSKRACCEG LRCKLWCRKI[1-Nal]-{Amide} |
| 49 | [Glu1]JzTx-V(1-29) | {H}-ECQKWMWTCDSKRACCE GLRCKLWCRKII-{Amide} |
| 50 | [Glu3]JzTx-V(1-29) | {H}-YCEKWMWTCDSKRACCE GLRCKLWCRKII-{Amide} |
| 51 | [Glu4]JzTx-V(1-29) | {H}-YCQEWMWTCDSKRACCE GLRCKLWCRKII-{Amide} |
| 52 | [Glu5]JzTx-V(1-29) | {H}-YCQKEMWTCDSKRACCE GLRCKLWCRKII-{Amide} |
| 53 | [Glu6]JzTx-V(1-29) | {H}-YCQKWEWTCDSKRACCE GLRCKLWCRKII-{Amide} |
| 54 | [Glu7]JzTx-V(1-29) | {H}-YCQKWMETCDSKRACCE GLRCKLWCRKII-{Amide} |
| 55 | [Glu8]JzTx-V(1-29) | {H}-YCQKWMWECDSKRACCE GLRCKLWCRKII-{Amide} |
| 56 | [Glu10]JzTx-V(1-29) | {H}-YCQKWMWTCESKRACCE GLRCKLWCRKII-{Amide} |
| 57 | [Glu11]JzTx-V(1-29) | {H}-YCQKWMWTCDEKRACCE GLRCKLWCRKII-{Amide} |
| 58 | [Glu12]JzTx-V(1-29) | {H}-YCQKWMWTCDSERACCE GLRCKLWCRKII-{Amide} |
| 59 | [Glu13]JzTx-V(1-29) | {H}-YCQKWMWTCDSKEACCE GLRCKLWCRKII-{Amide} |
| 60 | [Glu14]JzTx-V(1-29) | {H}-YCQKWMWTCDSKRECCE GLRCKLWCRKII-{Amide} |
| 61 | [Glu18]JzTx-V(1-29) | {H}-YCQKWMWTCDSKRACCE ELRCKLWCRKII-{Amide} |
| 62 | [Glu19]JzTx-V(1-29) | {H}-YCQKWMWTCDSKRACCE GERCKLWCRKII-{Amide} |
| 63 | [Glu20]JzTx-V(1-29) | {H}-YCQKWMWTCDSKRACCE GLECKLWCRKII-{Amide} |
| 64 | [Glu22]JzTx-V(1-29) | {H}-YCQKWMWTCDSKRACCE GLRCELWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 65 | [Glu23]JzTx-V(1-29) | {H}-YCQKWMWTCDSKRACCE GLRCKEWCRKII-{Amide} |
| 66 | [Glu24]JzTx-V(1-29) | {H}-YCQKWMWTCDSKRACCE GLRCKLECRKII-{Amide} |
| 67 | [Glu26]JzTx-V(1-29) | {H}-YCQKWMWTCDSKRACCE GLRCKLWCEKII-{Amide} |
| 68 | [Glu27]JzTx-V(1-29) | {H}-YCQKWMWTCDSKRACCE GLRCKLWCREII-{Amide} |
| 69 | [Glu28]JzTx-V(1-29) | {H}-YCQKWMWTCDSKRACCE GLRCKLWCRKEI-{Amide} |
| 70 | [Glu29]JzTx-V(1-29) | {H}-YCQKWMWTCDSKRACCE GLRCKLWCRKIE-{Amide} |
| 71 | [Lys1]JzTx-V(1-29) | {H}-KCQKWMWTCDSKRACCE GLRCKLWCRKII-{Amide} |
| 72 | [Lys3]JzTx-V(1-29) | {H}-YCKKWMWTCDSKRACCE GLRCKLWCRKII-{Amide} |
| 73 | [Lys5]JzTx-V(1-29) | {H}-YCQKKMWTCDSKRACCE GLRCKLWCRKII-{Amide} |
| 74 | [Lys6]JzTx-V(1-29) | {H}-YCQKWKWTCDSKRACCE GLRCKLWCRKII-{Amide} |
| 75 | [Lys7]JzTx-V(1-29) | {H}-YCQKWMKTCDSKRACCE GLRCKLWCRKII-{Amide} |
| 76 | [Lys8]JzTx-V(1-29) | {H}-YCQKWMWKCDSKRACCE GLRCKLWCRKII-{Amide} |
| 77 | [Lys10]JzTx-V(1-29) | {H}-YCQKWMWTCKSKRACCE GLRCKLWCRKII-{Amide} |
| 78 | [Lys11]JzTx-V(1-29) | {H}-YCQKWMWTCDKKRACCE GLRCKLWCRKII-{Amide} |
| 79 | [Lys13]JzTx-V(1-29) | {H}-YCQKWMWTCDSKKACCE GLRCKLWCRKII-{Amide} |
| 80 | [Lys14]JzTx-V(1-29) | {H}-YCQKWMWTCDSKRKCCE GLRCKLWCRKII-{Amide} |
| 81 | [Lys17]JzTx-V(1-29) | {H}-YCQKWMWTCDSKRACCK GLRCKLWCRKII-{Amide} |
| 82 | [Lys18]JzTx-V(1-29) | {H}-YCQKWMWTCDSKRACCE KLRCKLWCRKII-{Amide} |
| 83 | [Lys19]JzTx-V(1-29) | {H}-YCQKWMWTCDSKRACCE GKRCKLWCRKII-{Amide} |
| 84 | [Lys20]JzTx-V(1-29) | {H}-YCQKWMWTCDSKRACCE GLKCKLWCRKII-{Amide} |
| 85 | [Lys23]JzTx-V(1-29) | {H}-YCQKWMWTCDSKRACCE GLRCKKWCRKII-{Amide} |
| 86 | [Lys24]JzTx-V(1-29) | {H}-YCQKWMWTCDSKRACCE GLRCKLKCRKII-{Amide} |
| 87 | [Lys26]JzTx-V(1-29) | {H}-YCQKWMWTCDSKRACCE GLRCKLWCKKII-{Amide} |
| 88 | [Lys28]JzTx-V(1-29) | {H}-YCQKWMWTCDSKRACCE GLRCKLWCRKKI-{Amide} |

TABLE 5-continued

Amino acid sequences of JzTx-V and JzTx-V peptide analogs.

| SEQ ID NO. | Designation | Amino Acid Sequence |
|---|---|---|
| 89 | [Lys29]JzTx-V(1-29) | {H}-YCQKWMWTCDSKRACCE GLRCKLWCRKIK-{Amide} |
| 90 | [Arg1]JzTx-V(1-29) | {H}-RCQKWMWTCDSKRACCE GLRCKLWCRKII-{Amide} |
| 91 | [Arg3]JzTx-V(1-29) | {H}-YCRKWMWTCDSKRACCE GLRCKLWCRKII-{Amide} |
| 92 | [Arg4]JzTx-V(1-29) | {H}-YCQRWMWTCDSKRACCE GLRCKLWCRKII-{Amide} |
| 93 | [Arg5]JzTx-V(1-29) | {H}-YCQKRMWTCDSKRACCE GLRCKLWCRKII-{Amide} |
| 94 | [Arg6]JzTx-V(1-29) | {H}-YCQKWRWTCDSKRACCE GLRCKLWCRKII-{Amide} |
| 95 | [Arg7]JzTx-V(1-29) | {H}-YCQKWMRTCDSKRACCE GLRCKLWCRKII-{Amide} |
| 96 | [Arg8]JzTx-V(1-29) | {H}-YCQKWMWRCDSKRACCE GLRCKLWCRKII-{Amide} |
| 97 | [Arg10]JzTx-V(1-29) | {H}-YCQKWMWTCRSKRACCE GLRCKLWCRKII-{Amide} |
| 98 | [Arg11]JzTx-V(1-29) | {H}-YCQKWMWTCDRKRACCE GLRCKLWCRKII-{Amide} |
| 99 | [Arg12]JzTx-V(1-29) | {H}-YCQKWMWTCDSRRACCE GLRCKLWCRKII-{Amide} |
| 100 | [Arg14]JzTx-V(1-29) | {H}-YCQKWMWTCDSKRRCCE GLRCKLWCRKII-{Amide} |
| 101 | [Arg17]JzTx-V(1-29) | {H}-YCQKWMWTCDSKRACCR GLRCKLWCRKII-{Amide} |
| 102 | [Arg18]JzTx-V(1-29) | {H}-YCQKWMWTCDSKRACCE RLRCKLWCRKII-{Amide} |
| 103 | [Arg19]JzTx-V(1-29) | {H}-YCQKWMWTCDSKRACCE GRRCKLWCRKII-{Amide} |
| 104 | [Arg22]JzTx-V(1-29) | {H}-YCQKWMWTCDSKRACCE GLRCRLWCRKII-{Amide} |
| 105 | [Arg23]JzTx-V(1-29) | {H}-YCQKWMWTCDSKRACCE GLRCKRWCRKII-{Amide} |
| 106 | [Arg24]JzTx-V(1-29) | {H}-YCQKWMWTCDSKRACCE GLRCKLRCRKII-{Amide} |
| 107 | [Arg27]JzTx-V(1-29) | {H}-YCQKWMWTCDSKRACCE GLRCKLWCRRII-{Amide} |
| 108 | [Arg28]JzTx-V(1-29) | {H}-YCQKWMWTCDSKRACCE GLRCKLWCRKRI-{Amide} |
| 109 | [Arg29]JzTx-V(1-29) | {H}-YCQKWMWTCDSKRACCE GLRCKLWCRKIR-{Amide} |
| 110 | [Nle6;Glu20]JzTx-V(1-29) | {H}-YCQKW[Nle]WTCDSKR ACCEGLECKLWCRKII-{Amide} |
| 111 | [Nva6;Glu20]JzTx-V(1-29) | {H}-YCQKW[Nva]WTCDSKR ACCEGLECKLWCRKII-{Amide} |
| 112 | [Glu20;Trp29]JzTx-V(1-29) | {H}-YCQKWMWTCDSKRACCE GLECKLWCRKIW-{Amide} |

TABLE 5-continued

Amino acid sequences of JzTx-V and JzTx-V peptide analogs.

| SEQ ID NO. | Designation | Amino Acid Sequence |
|---|---|---|
| 113 | [Glu20]JzTx-V(1-29)-Trp | {H}-YCQKWMWTCDSKRACCE GLECKLWCRKIIW-{Amide} |
| 114 | [Cpa20]JzTx-V(1-29) | {H}-YCQKWMWTCDSKRACCE GL[Cpa]CKLWCRKII-{Amide} |
| 115 | [Asp20]JzTx-V(1-29) | {H}-YCQKWMWTCDSKRACCE GLDCKLWCRKII-{Amide} |
| 116 | [4-Cl-F20]JzTx-V(1-29) | {H}-YCQKWMWTCDSKRACCE GL[4-Cl-F]CKLWCRKII-{Amide} |
| 117 | [Abu20]JzTx-V(1-29) | {H}-YCQKWMWTCDSKRACCE GL[Abu]CKLWCRKII-{Amide} |
| 118 | [Ile20]JzTx-V(1-29) | {H}-YCQKWMWTCDSKRACCE GLICKLWCRKII-{Amide} |
| 119 | [Leu20]JzTx-V(1-29) | {H}-YCQKWMWTCDSKRACCE GLLCKLWCRKII-{Amide} |
| 120 | [Val20]JzTx-V(1-29) | {H}-YCQKWMWTCDSKRACCE GLVCKLWCRKII-{Amide} |
| 121 | [Gly20]JzTx-V(1-29) | {H}-YCQKWMWTCDSKRACCE GLGCKLWCRKII-{Amide} |
| 122 | [Cit20]JzTx-V(1-29) | {H}-YCQKWMWTCDSKRACCE GL[Cit]CKLWCRKII-{Amide} |
| 123 | [Nva20]JzTx-V(1-29) | {H}-YCQKWMWTCDSKRACCE GL[Nva]CKLWCRKII-{Amide} |
| 124 | [Tyr20]JzTx-V(1-29) | {H}-YCQKWMWTCDSKRACCE GLYCKLWCRKII-{Amide} |
| 125 | [Ser20]JzTx-V(1-29) | {H}-YCQKWMWTCDSKRACCE GLSCKLWCRKII-{Amide} |
| 126 | [Glu20,28]JzTx-V(1-29) | {H}-YCQKWMWTCDSKRACCE GLECKLWCRKEI-{Amide} |
| 127 | [Glu20;Cpa28]JzTx-V(1-29) | {H}-YCQKWMWTCDSKRACCE GLECKLWCRK[Cpa]I-{Amide} |
| 128 | [Glu20;Asp28]JzTx-V(1-29) | {H}-YCQKWMWTCDSKRACCE GLECKLWCRKDI-{Amide} |
| 129 | [Glu20;4-Cl-F28]JzTx-V(1-29) | {H}-YCQKWMWTCDSKRACCE GLECKLWCRK[4-Cl-F]I-{Amide} |
| 130 | [Glu20;Abu28]JzTx-V(1-29) | {H}-YCQKWMWTCDSKRACCE GLECKLWCRK[Abu]I-{Amide} |
| 131 | [Glu20]JzTx-V(1-29) | {H}-YCQKWMWTCDSKRACCE GLECKLWCRKII-{Amide} |
| 132 | [Glu20;Leu28]JzTx-V(1-29) | {H}-YCQKWMWTCDSKRACCE GLECKLWCRKLI-{Amide} |
| 133 | [Glu20;Val28]JzTx-V(1-29) | {H}-YCQKWMWTCDSKRACCE GLECKLWCRKVI-{Amide} |

TABLE 5-continued

Amino acid sequences of JzTx-V and JzTx-V peptide analogs.

| SEQ ID NO. | Designation | Amino Acid Sequence |
|---|---|---|
| 134 | [Glu20;Gly28]JzTx-V(1-29) | {H}-YCQKWMWTCDSKRACCE GLECKLWCRKGI-{Amide} |
| 135 | [Glu20;Cit28]JzTx-V(1-29) | {H}-YCQKWMWTCDSKRACCE GLECKLWCRK[Cit]I-{Amide} |
| 136 | [Glu20;Nva28]JzTx-V(1-29) | {H}-YCQKWMWTCDSKRACCE GLECKLWCRK[Nva]I-{Amide} |
| 137 | [Glu20;Tyr28]JzTx-V(1-29) | {H}-YCQKWMWTCDSKRACCE GLECKLWCRKYI-{Amide} |
| 138 | [Glu20;Ser28]JzTx-V(1-29) | {H}-YCQKWMWTCDSKRACCE GLECKLWCRKSI-{Amide} |
| 139 | 4-Pen-[Glu20]JzTx-V(1-29) | {4-Pen}-YCQKWMWTCDSKR ACCEGLECKLWCRKII-{Amide} |
| 140 | [Pra1;Glu20]JzTx-V(1-29) | {H}-[Pra]CQKWMWTCDSKR ACCEGLECKLWCRKII-{Amide} |
| 141 | [Pra3;Glu20]JzTx-V(1-29) | {H}-YC[Pra]KWMWTCDSKR ACCEGLECKLWCRKII-{Amide} |
| 142 | [Pra4;Glu20]JzTx-V(1-29) | {H}-YCQ[Pra]WMWTCDSKR ACCEGLECKLWCRKII-{Amide} |
| 143 | [Pra5;Glu20]JzTx-V(1-29) | {H}-YCQK[Pra]MWTCDSKR ACCEGLECKLWCRKII-{Amide} |
| 144 | [Pra6;Glu20]JzTx-V(1-29) | {H}-YCQKW[Pra]WTCDSKR ACCEGLECKLWCRKII-{Amide} |
| 145 | [Pra7;Glu20]JzTx-V(1-29) | {H}-YCQKWM[Pra]TCDSKR ACCEGLECKLWCRKII-{Amide} |
| 146 | [Pra8;Glu20]JzTx-V(1-29) | {H}-YCQKWMW[Pra]CDSKR ACCEGLECKLWCRKII-{Amide} |
| 147 | [Pra9;Glu20]JzTx-V(1-29) | {H}-YCQKWMWT[Pra]DSKR ACCEGLECKLWCRKII-{Amide} |
| 148 | [Pra10;Glu20+JzTx-V(1-29) | {H}-YCQKWMWTC[Pra]SKR ACCEGLECKLWCRKII-{Amide} |
| 149 | [Pra11;Glu20]JzTx-V(1-29) | {H}-YCQKWMWTCD[Pra]KR ACCEGLECKLWCRKII-{Amide} |
| 150 | [Pra12;Glu20]JzTx-V(1-29) | {H}-YCQKWMWTCDS[Pra]R ACCEGLECKLWCRKII-{Amide} |
| 151 | [Pra13;Glu20]JzTx-V(1-29) | {H}-YCQKWMWTCDSK[Pra] ACCEGLECKLWCRKII-{Amide} |
| 152 | [Pra14;Glu20]JzTx-V(1-29) | {H}-YCQKWMWTCDSKR [Pra]CCEGLECKLWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 153 | [Pra17;Glu20]JzTx-V(1-29) | {H}-YCQKWMWTCDSKRACC [Pra]GLECKLWCRKII- {Amide} |
| 154 | [Pra18;Glu20]JzTx-V(1-29) | {H}-YCQKWMWTCDSKRACCE [Pra]LECKLWCRKII- {Amide} |
| 155 | [Pra19;Glu20]JzTx-V(1-29) | {H}-YCQKWMWTCDSKRACCE G[Pra]ECKLWCRKII- {Amide} |
| 156 | [Pra20]JzTx-V(1-29) | {H}-YCQKWMWTCDSKRACCE GL[Pra]CKLWCRKII- {Amide} |
| 157 | [Glu20;Pra22]JzTx-V(1-29) | {H}-YCQKWMWTCDSKRACCE GLEC[Pra]LWCRKII- {Amide} |
| 158 | [Glu20;Pra23]JzTx-V(1-29) | {H}-YCQKWMWTCDSKRACCE GLECK[Pra]WCRKII- {Amide} |
| 159 | [Glu20;Pra24]JzTx-V(1-29) | {H}-YCQKWMWTCDSKRACCE GLECKL[Pra]CRKII- {Amide} |
| 160 | [Glu20;Pra26]JzTx-V(1-29) | {H}-YCQKWMWTCDSKRACCE GLECKLWC[Pra]KII- {Amide} |
| 161 | [Glu20;Pra27]JzTx-V(1-29) | {H}-YCQKWMWTCDSKRACCE GLECKLWCR[Pra]II- {Amide} |
| 162 | [Glu20;Pra28]JzTx-V(1-29) | {H}-YCQKWMWTCDSKRACCE GLECKLWCRK[Pra]I- {Amide} |
| 163 | [Glu20;Pra29]JzTx-V(1-29) | {H}-YCQKWMWTCDSKRACCE GLECKLWCRKI[Pra]- {Amide} |
| 164 | 4-Pen-[Glu20]JzTx-V(1-29) | {4-Pen}-YCQKWMWTCDSKR ACCEGLECKLWCRKII- {Amide} |
| 165 | [Pra(NPeg9)1;Glu20]JzTx-V(1-29) | {H}-[Atz(PEG10)CQKWMW TCDSKRACCEGLECKLWCRKI I-{Amide} |
| 166 | [Pra(NPeg9)3;Glu20]JzTx-V(1-29) | {H}-YC[Atz(PEG10)KWMW TCDSKRACCEGLECKLWCRKI I-{Amide} |
| 167 | [Pra(NPeg9)4;Glu20]JzTx-V(1-29) | {H}-YCQ[Atz(PEG10)WMW TCDSKRACCEGLECKLWCRKI I-{Amide} |
| 168 | [Pra(NPeg9)5;Glu20]JzTx-V(1-29) | {H}-YCQK[Atz(PEG10)MW TCDSKRACCEGLECKLWCRKI I-{Amide} |
| 169 | [Pra(NPeg9)6;Glu20]JzTx-V(1-29) | {H}-YCQKW[Atz(PEG10)W TCDSKRACCEGLECKLWCRKI I-{Amide} |
| 170 | [Pra(NPeg9)7;Glu20]JzTx-V(1-29) | {H}-YCQKWM[Atz(PEG10) TCDSKRACCEGLECKLWCRKI I-{Amide} |

TABLE 5-continued

Amino acid sequences of JzTx-V and JzTx-V peptide analogs.

| SEQ ID NO. | Designation | Amino Acid Sequence |
|---|---|---|
| 171 | [Pra(NPeg9)8;Glu20]JzTx-V(1-29) | {H}-YCQKWMW [Atz(PEG10)CDSKRACCEG LECKLWCRKII-{Amide} |
| 172 | [Pra(NPeg9)9;Glu20]JzTx-V(1-29) | {H}-YCQKWMWT [Atz(PEG10)DSKRACCEGL ECKLWCRKII-{Amide} |
| 173 | [Pra(NPeg9)10;Glu20]JzTx-V(1-29) | {H}-YCQKWMWTC [Atz(PEG10)SKRACCEGLE CKLWCRKII-{Amide} |
| 174 | [Pra(NPeg9)11;Glu20]JzTx-V(1-29) | {H}-YCQKWMWTCD [Atz(PEG10)KRACCEGLEC KLWCRKII-{Amide} |
| 175 | [Pra(NPeg9)12;Glu20]JzTx-V(1-29) | {H}-YCQKWMWTCDS [Atz(PEG10)RACCEGLECK LWCRKII-{Amide} |
| 176 | [Pra(NPeg9)13;Glu20]JzTx-V(1-29) | {H}-YCQKWMWTCDSK [Atz(PEG10)ACCEGLECKL WCRKII-{Amide} |
| 177 | [Pra(NPeg9)14;Glu20]JzTx-V(1-29) | {H}-YCQKWMWTCDSKR [Atz(PEG10)CCEGLECKLW CRKII-{Amide} |
| 178 | [Pra(NPeg9)17;Glu20]JzTx-V(1-29) | {H}-YCQKWMWTCDSKRACC [Atz(PEG10)GLECKLWCRK II-{Amide} |
| 179 | [Pra(NPeg9)18;Glu20]JzTx-V(1-29) | {H}-YCQKWMWTCDSKRACCE [Atz(PEG10)LECKLWCRKI I-{Amide} |
| 180 | [Pra(NPeg9)19;Glu20]JzTx-V(1-29) | {H}-YCQKWMWTCDSKRACCE G[Atz(PEG10)ECKLWCRKI I-{Amide} |
| 181 | [(NPeg9)20]JzTx-V(1-29) | {H}-YCQKWMWTCDSKRACCE GL[Atz(PEG10)CKLWCRKI I-{Amide} |
| 182 | [Glu20;Pra(NPeg9)22]JzTx-V(1-29) | {H}-YCQKWMWTCDSKRACCE GLEC[Atz(PEG10)LWCRKI I-{Amide} |
| 183 | [Glu20;Pra(NPeg9)23]JzTx-V(1-29) | {H}-YCQKWMWTCDSKRACCE GLECK[Atz(PEG10)WCRKI I-{Amide} |
| 184 | [Glu20;Pra(NPeg9)24]JzTx-V(1-29) | {H}-YCQKWMWTCDSKRACCE GLECKL[Atz(PEG10)CRKI I-{Amide} |
| 185 | [Glu20;Pra(NPeg9)26]JzTx-V(1-29) | {H}-YCQKWMWTCDSKRACCE GLECKLWC[Atz(PEG10)KI I-{Amide} |
| 186 | [Glu20;Pra(NPeg9)27]JzTx-V(1-29) | {H}-YCQKWMWTCDSKRACCE GLECKLWCR[Atz(PEG10)I I-{Amide} |
| 187 | [Glu20;Pra(NPeg9)28]JzTx-V(1-29) | {H}-YCQKWMWTCDSKRACCE GLECKLWCRK[Atz(PEG10) I-{Amide} |
| 188 | [Glu20;Pra(NPeg9)29]JzTx-V(1-29) | {H}-YCQKWMWTCDSKRACCE GLECKLWCRKI {Atz(PEG10)-{Amide} |

TABLE 5-continued

Amino acid sequences of JzTx-V and JzTx-V peptide analogs.

| SEQ ID NO. | Designation | Amino Acid Sequence |
|---|---|---|
| 189 | [Nle6;Glu20;Tyr28]JzTx-V(1-29) | {H}-YCQKW[Nle]WTCDSKR ACCEGLECKLWCRKYI-{Amide} |
| 190 | [1-Nal5;Glu20;Tyr28]JzTx-V(1-29) | {H}-YCQK[1-Nal]MWTCDS KRACCEGLECKLWCRKYI-{Amide} |
| 191 | [2-Nal5;Glu20;Tyr28]JzTx-V(1-29) | {H}-YCQK[2-Nal]MWTCDS KRACCEGLECKLWCRKYI-{Amide} |
| 192 | [pI-Phe5;Glu20;Tyr28]JzTx-V(1-29) | {H}-YCQK[pI-Phe]MWTCD SKRACCEGLECKLWCRKYI-{Amide} |
| 193 | [Phe5;Glu20;Tyr28]JzTx-V(1-29) | {H}-YCQKFMWTCDSKRACCE GLECKLWCRKYI-{Amide} |
| 194 | [Tyr5,28;Glu20]JzTx-V(1-29) | {H}-YCQKYMWTCDSKRACCE GLECKLWCRKYI-{Amide} |
| 195 | [Val5;Glu20;Tyr28]JzTx-V(1-29) | {H}-YCQKVMWTCDSKRACCE GLECKLWCRKYI-{Amide} |
| 196 | [Leu5;Glu20;Tyr28]JzTx-V(1-29) | {H}-YCQKLMWTCDSKRACCE GLECKLWCRKYI-{Amide} |
| 197 | [Nle5;Glu20;Tyr28]JzTx-V(1-29) | {H}-YCQK[Nle]MWTCDSKR ACCEGLECKLWCRKYI-{Amide} |
| 198 | [Nva5;Glu20;Tyr28]JzTx-V(1-29) | {H}-YCQK[Nva]MWTCDSKR ACCEGLECKLWCRKYI-{Amide} |
| 199 | [Cit5;Glu20;Tyr28]JzTx-V(1-29) | {H}-YCQK[Cit]MWTCDSKR ACCEGLECKLWCRKYI-{Amide} |
| 200 | [Lys5;Glu20;Tyr28]JzTx-V(1-29) | {H}-YCQKKMWTCDSKRACCE GLECKLWCRKYI-{Amide} |
| 201 | [Asn5;Glu20;Tyr28]JzTx-V(1-29) | {H}-YCQKNMWTCDSKRACCE GLECKLWCRKYI-{Amide} |
| 202 | [Ser5;Glu20;Tyr28]JzTx-V(1-29) | {H}-YCQKSMWTCDSKRACCE GLECKLWCRKYI-{Amide} |
| 203 | [Glu5,20;Tyr28]JzTx-V(1-29) | {H}-YCQKEMWTCDSKRACCE GLECKLWCRKYI-{Amide} |
| 204 | [1-Nal7;Glu20;Tyr28]JzTx-V(1-29) | {H}-YCQKWM[1-Nal]TCDS KRACCEGLECKLWCRKYI-{Amide} |
| 205 | [2-Nal7;Glu20;Tyr28]JzTx-V(1-29) | {H}-YCQKWM[2-Nal]TCDS KRACCEGLECKLWCRKYI-{Amide} |
| 206 | [pI-Phe7;Glu20;Tyr28]JzTx-V(1-29) | {H}-YCQKWM[pI-Phe]TCD SKRACCEGLECKLWCRKYI-{Amide} |
| 207 | [Phe7;Glu20;Tyr28]JzTx-V(1-29) | {H}-YCQKWMFTCDSKRACCE GLECKLWCRKYI-{Amide} |
| 208 | [Tyr7,28;Glu20]JzTx-V(1-29) | {H}-YCQKWMYTCDSKRACCE GLECKLWCRKYI-{Amide} |
| 209 | [Val7;Glu20;Tyr28]JzTx-V(1-29) | {H}-YCQKWMVTCDSKRACCE GLECKLWCRKYI-{Amide} |

TABLE 5-continued

Amino acid sequences of JzTx-V and JzTx-V peptide analogs.

| SEQ ID NO. | Designation | Amino Acid Sequence |
|---|---|---|
| 210 | [Leu7;Glu20;Tyr28]JzTx-V(1-29) | {H}-YCQKWMLTCDSKRACCE GLECKLWCRKYI-{Amide} |
| 211 | [Nle7;Glu20;Tyr28]JzTx-V(1-29) | {H}-YCQKWM[Nle]TCDSKR ACCEGLECKLWCRKYI-{Amide} |
| 212 | [Nva7;Glu20;Tyr28]JzTx-V(1-29) | {H}-YCQKWM[Nva]TCDSKR ACCEGLECKLWCRKYI-{Amide} |
| 213 | [Cit7;Glu20;Tyr28]JzTx-V(1-29) | {H}-YCQKWM[Cit]TCDSKR ACCEGLECKLWCRKYI-{Amide} |
| 214 | [Lys7;Glu20;Tyr28]JzTx-V(1-29) | {H}-YCQKWMKTCDSKRACCE GLECKLWCRKYI-{Amide} |
| 215 | [Asn7;Glu20;Tyr28]JzTx-V(1-29) | {H}-YCQKWMNTCDSKRACCE GLECKLWCRKYI-{Amide} |
| 216 | [Ser7;Glu20;Tyr28]JzTx-V(1-29) | {H}-YCQKWMSTCDSKRACCE GLECKLWCRKYI-{Amide} |
| 217 | [Glu7,20;Tyr28]JzTx-V(1-29) | {H}-YCQKWMETCDSKRACCE GLECKLWCRKYI-{Amide} |
| 218 | [Glu20;1-Nal24;Tyr28]JzTx-V(1-29) | {H}-YCQKWMWTCDSKRACCE GLECKL[1-Nal]CRKYI-{Amide} |
| 219 | [Glu20;2-Nal24;Tyr28]JzTx-V(1-29) | {H}-YCQKWMWTCDSKRACCE GLECKL[2-Nal]CRKYI-{Amide} |
| 220 | [Glu20;pI-Phe24;Tyr28]JzTx-V(1-29) | {H}-YCQKWMWTCDSKRACCE GLECKL[pI-Phe]CRKYI-{Amide} |
| 221 | [Glu20;Phe24;Tyr28]JzTx-V(1-29) | {H}-YCQKWMWTCDSKRACCE GLECKLFCRKYI-{Amide} |
| 222 | [Glu20;Tyr24,28]JzTx-V(1-29) | {H}-YCQKWMWTCDSKRACCE GLECKLYCRKYI-{Amide} |
| 223 | [Glu20;Val24;Tyr28]JzTx-V(1-29) | {H}-YCQKWMWTCDSKRACCE GLECKLVCRKYI-{Amide} |
| 224 | [Glu20;Leu24;Tyr28]JzTx-V(1-29) | {H}-YCQKWMWTCDSKRACCE GLECKLLCRKYI-{Amide} |
| 225 | [Glu20;Nle24;Tyr28]JzTx-V(1-29) | {H}-YCQKWMWTCDSKRACCE GLECKL[Nle]CRKYI-{Amide} |
| 226 | [Glu20;Nva24;Tyr28]JzTx-V(1-29) | {H}-YCQKWMWTCDSKRACCE GLECKL[Nva]CRKYI-{Amide} |
| 227 | [Glu20;Cit24;Tyr28]JzTx-V(1-29) | {H}-YCQKWMWTCDSKRACCE GLECKL[Cit]CRKYI-{Amide} |
| 228 | [Glu20;Lys24;Tyr28]JzTx-V(1-29) | {H}-YCQKWMWTCDSKRACCE GLECKLKCRKYI-{Amide} |
| 229 | [Glu20;Asn24;Tyr28]JzTx-V(1-29) | {H}-YCQKWMWTCDSKRACCE GLECKLNCRKYI-{Amide} |
| 230 | [Glu20;Ser24;Tyr28]JzTx-V(1-29) | {H}-YCQKWMWTCDSKRACCE GLECKLSCRKYI-{Amide} |

TABLE 5-continued

Amino acid sequences of JzTx-V and JzTx-V peptide analogs.

| SEQ ID NO. | Designation | Amino Acid Sequence |
|---|---|---|
| 231 | [Glu20,24;Tyr28]JzTx-V(1-29) | {H}-YCQKWMWTCDSKRACCE GLECKLECRKYI-{Amide} |
| 232 | [Glu20;Tyr28;1-Nal29]JzTx-V(1-29) | {H}-YCQKWMWTCDSKRACCE GLECKLWCRKY[1-Nal]-{Amide} |
| 233 | [Glu20;Tyr28;2-Nal29]JzTx-V(1-29) | {H}-YCQKWMWTCDSKRACCE GLECKLWCRKY[2-Nal]-{Amide} |
| 234 | [Glu20;Tyr28;pI-Phe29]JzTx-V(1-29) | {H}-YCQKWMWTCDSKRACCE GLECKLWCRKY[pI-Phe]-{Amide} |
| 235 | [Glu20;Tyr28;Phe29]JzTx-V(1-29) | {H}-YCQKWMWTCDSKRACCE GLECKLWCRKYF-{Amide} |
| 236 | [Glu20;Tyr28,29]JzTx-V(1-29) | {H}-YCQKWMWTCDSKRACCE GLECKLWCRKYY-{Amide} |
| 237 | [Glu20;Tyr28;Val29]JzTx-V(1-29) | {H}-YCQKWMWTCDSKRACCE GLECKLWCRKYV-{Amide} |
| 238 | [Glu20;Tyr28;Leu29]JzTx-V(1-29) | {H}-YCQKWMWTCDSKRACCE GLECKLWCRKYL-{Amide} |
| 239 | [Glu20;Tyr28;Nle29]JzTx-V(1-29) | {H}-YCQKWMWTCDSKRACCE GLECKLWCRKY[Nle]-{Amide} |
| 240 | [Glu20;Tyr28;Nva29]JzTx-V(1-29) | {H}-YCQKWMWTCDSKRACCE GLECKLWCRKY[Nva]-{Amide} |
| 241 | [Glu20;Tyr28;Cit29]JzTx-V(1-29) | {H}-YCQKWMWTCDSKRACCE GLECKLWCRKY[Cit]-{Amide} |
| 242 | [Glu20;Tyr28;Lys29]JzTx-V(1-29) | {H}-YCQKWMWTCDSKRACCE GLECKLWCRKYK-{Amide} |
| 243 | [Glu20;Tyr28;Asn29]JzTx-V(1-29) | {H}-YCQKWMWTCDSKRACCE GLECKLWCRKYN-{Amide} |
| 244 | [Glu20;Tyr28;Ser29]JzTx-V(1-29) | {H}-YCQKWMWTCDSKRACCE GLECKLWCRKYS-{Amide} |
| 245 | [Glu20,29;Tyr28]JzTx-V(1-29) | {H}-YCQKWMWTCDSKRACCE GLECKLWCRKYE-{Amide} |
| 246 | [Glu20;Tyr28;Trp29]JzTx-V(1-29) | {H}-YCQKWMWTCDSKRACCE GLECKLWCRKYW-{Amide} |
| 247 | Atz(PEG10)-[Nle6]JzTx-V(1-29) | {H}-[Atz(PEG10)YCQKW [Nle]WTCDSKRACCEGLRCK LWCRKII-{Amide} |
| 248 | [Atz(PEG10)1;Nle6]JzTx-V(1-29) | {H}-[Atz(PEG10)CQKW [Nle]WTCDSKRACCEGLRCK LWCRKII-{Amide} |
| 249 | [Atz(PEG10)3;Nle6]JzTx-V(1-29) | {H}-YC[Atz(PEG10)KW [Nle]WTCDSKRACCEGLRCK LWCRKII-{Amide} |
| 250 | [Atz(PEG10)4;Nle6]JzTx-V(1-29) | {H}-YCQ[Atz(PEG10)W [Nle]WTCDSKRACCEGLRCK LWCRKII-{Amide} |
| 251 | [Atz(PEG10)5;Nle6]JzTx-V(1-29) | {H}-YCQK[Atz(PEG10) [Nle]WTCDSKRACCEGLRCK LWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 252 | [Atz(PEG10)6]JzTx-V(1-29) | {H}-YCQKW[Atz(PEG10) WTCDSKRACCEGLRCKLWCRK II-{Amide} |
| 253 | [Nle6;Atz(PEG10)7]JzTx-V(1-29) | {H}-YCQKW[Nle] [Atz(PEG10)TCDSKRACCE GLRCKLWCRKII-{Amide} |
| 254 | [Nle6;Atz(PEG10)8]JzTx-V(1-29) | {H}-YCQKW[Nle]W [Atz(PEG10)CDSKRACCEG LRCKLWCRKII-{Amide} |
| 255 | [Nle6;Atz(PEG10)10]JzTx-V(1-29) | {H}-YCQKW[Nle]WTC [Atz(PEG10)SKRACCEGLR CKLWCRKII-{Amide} |
| 256 | [Nle6;Atz(PEG10)11]JzTx-V(1-29) | {H}-YCQKW[Nle]WTCD [Atz(PEG10)KRACCEGLRC KLWCRKII-{Amide} |
| 257 | [Nle6;Atz(PEG10)12]JzTx-V(1-29) | {H}-YCQKW[Nle]WTCDS [Atz(PEG10)RACCEGLRCK LWCRKII-{Amide} |
| 258 | [Nle6;Atz(PEG10)13]JzTx-V(1-29) | {H}-YCQKW[Nle]WTCDSK [Atz(PEG10)ACCEGLRCKL WCRKII-{Amide} |
| 259 | [Nle6;Atz(PEG10)14]JzTx-V(1-29) | {H}-YCQKW[Nle]WTCDSKR [Atz(PEG10)CCEGLRCKLW CRKII-{Amide} |
| 260 | [Nle6;Atz(PEG10)17]JzTx-V(1-29) | {H}-YCQKW[Nle]WTCDSKR ACC[Atz(PEG10)GLRCKLW CRKII-{Amide} |
| 261 | [Nle6;Atz(PEG10)18]JzTx-V(1-29) | {H}-YCQKW[Nle]WTCDSKR ACCE[Atz(PEG10)LRCKLW CRKII-{Amide} |
| 262 | [Nle6;Atz(PEG10)19]JzTx-V(1-29) | {H}-YCQKW[Nle]WTCDSKR ACCEG[Atz(PEG10)RCKLW CRKII-{Amide} |
| 263 | [Nle6;Atz(PEG10)20]JzTx-V(1-29) | {H}-YCQKW[Nle]WTCDSKR ACCEGL[Atz(PEG10)CKLW CRKII-{Amide} |
| 264 | [Nle6;Atz(PEG10)22]JzTx-V(1-29) | {H}-YCQKW[Nle]WTCDSKR ACCEGLRC[Atz(PEG10)LW CRKII-{Amide} |
| 265 | [Nle6;Atz(PEG10)23]JzTx-V(1-29) | {H}-YCQKW[Nle]WTCDSKR ACCEGLRCK[Atz(PEG10)W CRKII-{Amide} |
| 266 | [Nle6;Atz(PEG10)24]JzTx-V(1-29) | {H}-YCQKW[Nle]WTCDSKR ACCEGLRCKL[Atz(PEG10) CRKII-{Amide} |
| 267 | [Nle6;Atz(PEG10)26]JzTx-V(1-29) | {H}-YCQKW[Nle]WTCDSKR ACCEGLRCKLWC[Atz (PEG10)KII-{Amide} |
| 268 | [Nle6;Atz(PEG10)27]JzTx-V(1-29) | {H}-YCQKW[Nle}WTCDSKR ACCEGLRCKLWCR[Atz (PEG10)II-{Amide} |
| 269 | [Nle6;Atz(PEG10)28]JzTx-V(1-29) | {H}-YCQKW[Nle]WTCDSKR ACCEGLRCKLWCRK[Atz (PEG10)I-{Amide} |

TABLE 5-continued

Amino acid sequences of JzTx-V and JzTx-V peptide analogs.

| SEQ ID NO. | Designation | Amino Acid Sequence |
|---|---|---|
| 270 | [Nle6;Atz(PEG10)29]JzTx-V(1-29) | {H}-YCQKW[Nle]WTCDSKRACCEGLRCKLWCRKI[Atz(PEG10)-{Amide} |
| 271 | [Nle6]JzTx-V(1-29)-Atz(PEG10) | {H}-YCQKW[Nle]WTCDSKRACCEGLRCKLWCRKII[Atz(PEG10)-{Amide} |
| 272 | [Nle6]JzTx-V(1-29) | {H}-YCQKW[Nle]WTCDSKRACCEGLRCKLWCRKII-{Amide} |
| 273 | [Nle6;Glu20]JzTx-V(1-29) | {H}-YCQKW[Nle]WTCDSKRACCEGLECKLWCRKII-{Amide} |
| 274 | [Nle6;Glu20;Trp29]JzTx-V(1-29) | {H}-YCQKW[Nle]WTCDSKRACCEGLECKLWCRKIW-{Amide} |
| 275 | [Nle6;Glu20;Ser28]JzTx-V(1-29) | {H}-YCQKW[Nle]WTCDSKRACCEGLECKLWCRKSI-{Amide} |
| 276 | [Glu20;Ser28;Trp29]JzTx-V(1-29) | {H}-YCQKWMWTCDSKRACCEGLECKLWCRKSW-{Amide} |
| 277 | [Glu1,20;Tyr28]JzTx-V(1-29) | {H}-ECQKWMWTCDSKRACCEGLECKLWCRKYI-{Amide} |
| 278 | [Glu1;Tyr28]JzTx-V(1-29) | {H}-ECQKWMWTCDSKRACCEGLRCKLWCRKYI-{Amide} |
| 279 | [Glu1,20;Tyr28;Trp29]JzTx-V(1-29) | {H}-ECQKWMWTCDSKRACCEGLECKLWCRKYW-{Amide} |
| 280 | [Glu1;Tyr28;Trp29]JzTx-V(1-29) | {H}-ECQKWMWTCDSKRACCEGLRCKLWCRKYW-{Amide} |
| 281 | [Glu1;1-Nal7]JzTx-V(1-29) | {H}-ECQKWM[1-Nal]TCDSKRACCEGLRCKLWCRKII-{Amide} |
| 282 | [Glu1;1-Nal7;Trp29]JzTx-V(1-29) | {H}-ECQKWM[1-Nal]TCDSKRACCEGLRCKLWCRKII-{Amide} |
| 283 | [Nle6,Pra14]JzTx-V(1-29) | {H}-YCQKW[Nle]WTCDSKR[Pra]CCEGLRCKLWCRKII-{Amide} |
| 284 | [Nle6;Pra17;Glu20;Trp29]JzTx-V(1-29) | {H}-YCQKW[Nle]WTCDSKRACC[Pra]GLECKLWCRKIW-{Amide} |
| 285 | [Nle6;Lys14;Glu20;Trp29]JzTx-V(1-29) | {H}-YCQKW[Nle]WTCDSK(ivDde)RKCCEGLECKLWCRKIW-{Amide} |
| 286 | [Nle6;Lys(Pra-Ahx)14;Glu20;Trp29]JzTx-V(1-29) | {H}-YCQKW[Nle]WTCDSKRK(Pra-Ahx)CCEGLECKLWCRKIW-{Amide} |
| 287 | [Nle6;Lys(Pra)14;Glu20;Trp29]JzTx-V(1-29) | {H}-YCQKW[Nle]WTCDSKRK(Pra)CCEGLECKLWCRKIW-{Amide} |
| 288 | [Nle6;Lys14;Glu20;Trp29]JzTx-V(1-29) | {H}-YCQKW[Nle]WTCDSKRK(ivDde)CCEGLECKLWCRKIW-{Amide} |

TABLE 5-continued

Amino acid sequences of JzTx-V and JzTx-V peptide analogs.

| SEQ ID NO. | Designation | Amino Acid Sequence |
|---|---|---|
| 289 | [Nle6;Lys17;Glu20;Trp29]JzTx-V(1-29) | {H}-YCQKW[Nle]WTCDSKR ACCK(ivDde)GLECKLWCRK IW-{Amide} |
| 290 | [Nle6;Lys(Pra-NPEG11)14;Glu20;Trp29] JzTx-V(1-29) | {H}-YCQKW[Nle]WTCDSKR [KPPG11]CCEGLECKLWCRK IW-{Amide} |
| 291 | [Nle6;Lys(Pra-NPEG3)14;Glu20;Trp29] JzTx-V(1-29) | {H}-YCQKW[Nle]WTCDSKR [KPPG3]CCEGLECKLWCRKI W-{Amide} |
| 292 | [Nle6;Lys(Pra-NPEG11)17;Glu20;Trp29] JzTx-V(1-29) | {H}-YCQKW[Nle]WTCDSKR ACC[KPPG11]GLECKLWCRK IW-{Amide} |
| 293 | [Nle6;Lys(Pra-NPEG3)17;Glu20;Trp29] JzTx-V(1-29) | {H}-YCQKW[Nle]WTCDSKR ACC[KPPG3]GLECKLWCRKI W-{Amide} |
| 294 | [Nle6;Glu20;Trp29]JzTx-V(1-29) | {H}-YCQKW[Nle]WTCDSKR ACCEGLECKLWCRKIW- {Amide} |
| 295 | Pra-[Glu20;Trp29]JzTx-V(1-29) | {H}-[Pra]YCQKWMWTCDSK RACCEGLECKLWCRKIW- {Amide} |
| 296 | Pra-[Nle6;Trp29]JzTx-V(1-29) | {H}-[Pra]YCQKW[Nle]WT CDSKRACCEGLRCKLWCRKI W-{Amide} |
| 297 | Pra-[Nle6;Glu20] JzTx-V(1-29) | {H}-[Pra]YCQKW[Nle]WT CDSKRACCEGLECKLWCRKI I-{Amide} |
| 298 | Pra-[Phe6;Glu20;Trp29]JzTx-V(1-29) | {H}-[Pra]YCQKWFWTCDSK RACCEGLECKLWCRKIW- {Amide} |
| 299 | Pra-[Leu6;Glu20;Trp29]JzTx-V(1-29) | {H}-[Pra]YCQKWLWTCDSK RACCEGLECKLWCRKIW- {Amide} |
| 300 | Pra-[Nva6;Glu20;Trp29]JzTx-V(1-29) | {H}-[Pra]YCQKW[Nva]WT CDSKRACCEGLECKLWCRKI W-{Amide} |
| 301 | Pra-[Nle6;Glu20;Phe29]JzTx-V(1-29) | {H}-[Pra]YCQKW[Nle]WT CDSKRACCEGLECKLWCRKI F-{Amide} |
| 302 | [Nle6;Pra11;Glu20;Trp29]JzTx-V(1-29) | {H}-YCQKW[Nle]WTCD [Pra]KRACCEGLECKLWCRK IW-{Amide} |
| 303 | AzK-[Nle6;Glu20;Trp29]JzTx-V(1-29) | {H}-[AzK]YCQKW[Nle]WT CDSKRACCEGLECKLWCRKI W-{Amide} |
| 304 | [AzK1 ;Nle6;Glu20;Trp29]JzTx-V(1-29) | {H}-[AzK]CQKW[Nle]WTC DSKRACCEGLECKLWCRKIW- {Amide} |
| 305 | [Nle6;AzK11;Glu20;Trp29]JzTx-V(1-29) | {H}-YCQKW[Nle]WTCD [AzK]KRACCEGLECKLWCRK IW-{Amide} |
| 306 | [Nle6;AzK14;Glu20;Trp29]JzTx-V(1-29) | {H}-YCQKW[Nle]WTCDSKR [AzK]CCEGLECKLWCRKIW- {Amide} |

TABLE 5-continued

Amino acid sequences of JzTx-V and JzTx-V peptide analogs.

| SEQ ID NO. | Designation | Amino Acid Sequence |
|---|---|---|
| 307 | [Nle6;AzK17;Glu20;Trp29]JzTx-V(1-29) | {H}-YCQKW[Nle]WTCDSKR ACC[AzK]GLECKLWCRKIW- {Amide} |
| 308 | Aha-[Nle6;Glu20;Trp29]JzTx-V(1-29) | {H}-[Aha]YCQKW[Nle]WT CDSKRACCEGLECKLWCRKI W-{Amide} |
| 309 | [Aha1;Nle6;Glu20;Trp29]JzTx-V(1-29) | {H}-[Aha]CQKW[Nle]WTC DSKRACCEGLECKLWCRKIW- {Amide} |
| 310 | [Nle6;Aha11;Glu20;Trp29]JzTx-V(1-29) | {H}-YCQKW[Nle]WTCD [Aha]KRACCEGLECKLWCRK IW-{Amide} |
| 311 | [Nle6;Aha14;Glu20;Trp29]JzTx-V(1-29) | {H}-YCQKW[Nle]WTCDSKR [Aha]CCEGLECKLWCRKIW- {Amide} |
| 312 | [Nle6;Aha17;Glu20;Trp29]JzTx-V(1-29) | {H}-YCQKW[Nle]WTCDSKR ACC[Aha]GLECKLWCRKIW- {Amide} |
| 313 | Pra-[Nle6;Glu20;Tyr28]JzTx-V(1-29) | {H}-[Pra]YCQKW[Nle]WT CDSKRACCEGLECKLWCRKY I-{Amide} |
| 314 | [Pra1;Nle6;Glu20;Tyr28]JzTx-V(1-29) | {H}-[Pra]CQKW[Nle]WTC DSKRACCEGLECKLWCRKYI- {Amide} |
| 315 | [Nle6;Pra11;Glu20;Tyr28]JzTx-V(1-29) | {H}-YCQKW[Nle]WTCD [Pra]KRACCEGLECKLWCRK YI-{Amide} |
| 316 | [Nle6;Pra14;Glu20;Tyr28]JzTx-V(1-29) | {H}-YCQKW[Nle]WTCDSKR [Pra]CCEGLECKLWCRKYI- {Amide} |
| 317 | [Nle6;Pra17;Glu20;Tyr28]JzTx-V(1-29) | {H}-YCQKW[Nle]WTCDSKR ACC[Pra]GLECKLWCRKYI- {Amide} |
| 318 | AzK-[Nle6;Glu20;Tyr28]JzTx-V(1-29) | {H}-[AzK]YCQKW[Nle]WT CDSKRACCEGLECKLWCRKY I-{Amide} |
| 319 | [AzK1;Nle6;Glu20;Tyr28]JzTx-V(1-29) | {H}-[AzK]CQKW[Nle]WTC DSKRACCEGLECKLWCRKYI- {Amide} |
| 320 | [Nle6;AzK11;Glu20;Tyr28]JzTx-V(1-29) | {H}-YCQKW[Nle]WTCD [AzK]KRACCEGLECKLWCRK YI-{Amide} |
| 321 | [Nle6;AzK14;Glu20;Tyr28]JzTx-V(1-29) | {H}-YCQKW[Nle]WTCDSKR [AzK]CCEGLECKLWCRKYI- {Amide} |
| 322 | [Nle6;AzK17;Glu20;Tyr28]JzTx-V(1-29) | {H}-YCQKW[Nle]WTCDSKR ACC[AzK]GLECKLWCRKYI- {Amide} |
| 323 | Aha-[Nle6;Glu20;Tyr28]JzTx-V(1-29) | {H}-[Aha]YCQKW[Nle]WT CDSKRACCEGLECKLWCRKY I-{Amide} |
| 324 | [Aha1;Nle6;Glu20;Tyr28]JzTx-V(1-29) | {H}-[Aha]CQKW[Nle]WTC DSKRACCEGLECKLWCRKYI- {Amide} |

TABLE 5-continued

Amino acid sequences of JzTx-V and JzTx-V peptide analogs.

| SEQ ID NO. | Designation | Amino Acid Sequence |
|---|---|---|
| 325 | [Nle6;Aha11;Glu20;Tyr28]JzTx-V(1-29) | {H}-YCQKW[Nle]WTCD [Aha]KRACCEGLECKLWCRK YI-{Amide} |
| 326 | [Nle6;Aha14;Glu20;Tyr28]JzTx-V(1-29) | {H}-YCQKW[Nle]WTCDSKR [Aha]CCEGLECKLWCRKYI- {Amide} |
| 327 | [Nle6;Aha17;Glu20;Tyr28]JzTx-V(1-29) | {H}-YCQKW[Nle]WTCDSKR ACC[Aha]GLECKLWCRKYI- {Amide} |
| 328 | Pra-[Nle6;Glu28]JzTx-V(1-29) | {H}-[Pra]YCQKW[Nle]WT CDSKRACCEGLRCKLWCRKE I-{Amide} |
| 329 | [Pra1;Nle6;Glu28]JzTx-V(1-29) | {H}-[Pra]CQKW[Nle]WTC DSKRACCEGLRCKLWCRKEI- {Amide} |
| 330 | [Nle6;Pra11;Glu28]JzTx-V(1-29) | {H}-YCQKW[Nle]WTCD [Pra]KRACCEGLRCKLWCRK EI-{Amide} |
| 331 | [Nle6;Pra14;Glu28]JzTx-V(1-29) | {H}-YCQKW[Nle]WTCDSKR [Pra]CCEGLRCKLWCRKEI- {Amide} |
| 332 | [Nle6;Pra17;Glu28]JzTx-V(1-29) | {H}-YCQKW[Nle]WTCDSKR ACC[Pra]GLRCKLWCRKEI- {Amide} |
| 333 | AzK-[Nle6;Glu28]JzTx-V(1-29) | {H}-[AzK]YCQKW[Nle]WT CDSKRACCEGLRCKLWCRKE I-{Amide} |
| 334 | [AzK1;Nle6;Glu28]JzTx-V(1-29) | {H}-[AzK]CQKW[Nle]WTC DSKRACCEGLRCKLWCRKEI- {Amide} |
| 335 | [Nle6;AzK11;Glu28]JzTx-V(1-29) | {H}-YCQKW[Nle]WTCD [AzK]KRACCEGLRCKLWCRK EI-{Amide} |
| 336 | [Nle6;AzK14;Glu28]JzTx-V(1-29) | {H}-YCQKW[Nle]WTCDSKR [AzK]CCEGLRCKLWCRKEI- {Amide} |
| 337 | [Nle6;AzK17;Glu28]JzTx-V(1-29) | {H}-YCQKW[Nle]WTCDSKR ACC[AzK]GLRCKLWCRKEI- {Amide} |
| 338 | Aha-[Nle6;Glu28]JzTx-V(1-29) | {H}-[Aha]YCQKW[Nle]WT CDSKRACCEGLRCKLWCRKE I-{Amide} |
| 339 | [Aha1;Nle6;Glu28]JzTx-V(1-29) | {H}-[Aha]CQKW[Nle]WTC DSKRACCEGLRCKLWCRKEI- {Amide} |
| 340 | [Nle6;Aha11;Glu28]JzTx-V(1-29) | {H}-YCQKW[Nle]WTCD [Aha]KRACCEGLRCKLWCRK EI-{Amide} |
| 341 | [Nle6;Aha14;Glu28]JzTx-V(1-29) | {H}-YCQKW[Nle]WTCDSKR [Aha]CCEGLRCKLWCRKEI- {Amide} |
| 342 | [Nle6;Aha17;Glu28]JzTx-V(1-29) | {H}-YCQKW[Nle]WTCDSKR ACC[Aha]GLRCKLWCRKEI- {Amide} |

TABLE 5-continued

Amino acid sequences of JzTx-V and JzTx-V peptide analogs.

| SEQ ID NO. | Designation | Amino Acid Sequence |
|---|---|---|
| 343 | [Pra1;Nle6;Glu20]JzTx-V(1-29) | {H}-[Pra]CQKW[Nle]WTC DSKRACCEGLECKLWCRKII-{Amide} |
| 344 | [Nle6;Pra11;Glu20]JzTx-V(1-29) | {H}-YCQKW[Nle]WTCD [Pra]KRACCEGLECKLWCRK II-{Amide} |
| 345 | [Nle6;Pra14;Glu20]JzTx-V(1-29) | {H}-YCQKW[Nle]WTCDSKR [Pra]CCEGLECKLWCRKII-{Amide} |
| 346 | [Nle6;Pra17;Glu20]JzTx-V(1-29) | {H}-YCQKW[Nle]WTCDSKR ACC[Pra]GLECKLWCRKII-{Amide} |
| 347 | AzK-Nle6;Glu20]JzTx-V(1-29) | {H}-[AzK]YCQKW[Nle]WT CDSKRACCEGLECKLWCRMI-{Amide} |
| 348 | [AzK1;Nle6;Glu20]JzTx-V(1-29) | {H}-[AzK]CQKW[Nle]WTC DSKRACCEGLECKLWCRKII-{Amide} |
| 349 | [Nle6;AzK11;Glu20]JzTx-V(1-29) | {H}-YCQKW[Nle]WTCD [AzK]KRACCEGLECKLWCRK II-{Amide} |
| 350 | [Nle6;AzK14;Glu20]JzTx-V(1-29) | {H}-YCQKW[Nle]WTCDSKR [AzK]CCEGLECKLWCRKII-{Amide} |
| 351 | [Nle6;AzK17;Glu20]JzTx-V(1-29) | {H}-YCQKW[Nle]WTCDSKR ACC[AzK]GLECKLWCRKII-{Amide} |
| 352 | Aha-[Nle6;Glu20]JzTx-V(1-29) | {H}-[Aha]YCQKW[Nle]WT CDSKRACCEGLECKLWCRKI I-{Amide} |
| 353 | [Aha1;Nle6; Glu20] JzTx-V(1-29) | {H}-[Aha]CQKW[Nle]WTC DSKRACCEGLECKLWCRKII-{Amide} |
| 354 | [Nle6;Aha11;Glu20]JzTx-V(1-29) | {H}-YCQKW[Nle]WTCD [Aha]KRACCEGLECKLWCRK II-{Amide} |
| 355 | [Nle6;Aha14;Glu20]JzTx-V(1-29) | {H}-YCQKW[Nle]WTCDSKR [Aha]CCEGLECKLWCRKII-{Amide} |
| 356 | [Nle6;Aha17;Glu20]JzTx-V(1-29) | {H}-YCQKW[Nle]WTCDSKR ACC[Aha]GLECKLWCRKII-{Amide] |
| 357 | Ala-[Nle6]JzTx-V(1-29) | {H}-AYCQKW[Nle]WTCDSK RACCEGLRCKLWCRKII-{Amide} |
| 358 | Phe-[Nle6]JzTx-V(1-29) | {H}-FYCQKW[Nle]WTCDSK RACCEGLRCKLWCRKII-{Amide} |
| 359 | Gly-[Nle6]JzTx-V(1-29) | {H}-GYCQKW[Nle]WTCDSK RACCEGLRCKLWCRKII-{Amide} |
| 360 | Ile-[Nle6]JzTx-V(1-29) | {H}-IYCQKW[Nle]WTCDSK RACCEGLRCKLWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 361 | Leu-[Nle6]JzTx-V(1-29) | {H}-LYCQKW[Nle]WTCDSK RACCEGLRCKLWCRKII-{Amide} |
| 362 | Pro-[Nle6]JzTx-V(1-29) | {H}-PYCQKW[Nle]WTCDSK RACCEGLRCKLWCRKII-{Amide} |
| 363 | Val-[Nle6]JzTx-V(1-29) | {H}-VYCQKW[Nle]WTCDSK RACCEGLRCKLWCRKII-{Amide} |
| 364 | Trp-[Nle6]JzTx-V(1-29) | {H}-WYCQKW[Nle]WTCDSK RACCEGLRCKLWCRKII-{Amide} |
| 365 | Tyr-[Nle6]JzTx-V(1-29) | {H}-YYCQKW[Nle]WTCDSK RACCEGLRCKLWCRKII-{Amide} |
| 366 | CyA-[Nle6]JzTx-V(1-29) | {H}-[CyA]YCQKW[Nle]WT CDSKRACCEGLRCKLWCRKI I-{Amide} |
| 367 | AllylG-[Nle6]JzTx-V(1-29) | {H}-[AllylG]YCQKW [Nle]WTCDSKRACCEGLRCK LWCRKII-{Amide} |
| 368 | Abu-[Nle6]JzTx-V(1-29) | {H}-[Abu]YCQKW[Nle]WT CDSKRACCEGLRCKLWCRKI I-{Amide} |
| 369 | Nva-[Nle6]JzTx-V(1-29) | {H}-[Nva]YCQKW[Nle]WT CDSKRACCEGLRCKLWCRKI I-{Amide} |
| 370 | Nle-[Nle6]JzTx-V(1-29) | {H}-[Nle]YCQKW[Nle]WT CDSKRACCEGLRCKLWCRKI I-{Amide} |
| 371 | OctylG-[Nle6]JzTx-V(1-29) | {H}-[OctylG]YCQKW [Nle]WTCDSKRACCEGLRCK LWCRKII- {Amide} |
| 372 | D-Ala-[Nle6]JzTx-V(1-29) | {H}-aYCQKW[Nle]WTCDSK RACCEGLRCKLWCRKII-{Amide} |
| 373 | D-Leu-[Nle6]JzTx-V(1-29) | {H}-lYCQKW[Nle]WTCDSK RACCEGLRCKLWCRKII-{Amide} |
| 374 | D-Phe-[Nle6]JzTx-V(1-29) | {H}-fYCQKW[Nle]WTCDSK RACCEGLRCKLWCRKII-{Amide} |
| 375 | Sar-[Nle6]JzTx-V(1-29) | {H}-[Sar]YCQKW[Nle]WT CDSKRACCEGLRCKLWCRKI I-{Amide} |
| 376 | bAla-[Nle6]JzTx-V(1-29) | {H}-[bAla]YCQKW[Nle]W TCDSKRACCEGLRCKLWCRKI I-{Amide} |
| 377 | hLeu-[Nle6]JzTx-V(1-29) | {H}-[hLeu]YCQKW[Nle}W TCDSKRACCEGLRCKLWCRKI I-{Amide} |
| 378 | 4-Cl-F-[Nle6]JzTx-V(1-29) | {H}-[4-Cl-F]YCQKW [Nle]WTCDSKRACCEGLRCK LWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 379 | hPhe-[Nle6]JzTx-V(1-29) | {H}-[hPhe]YCQKW[Nle]WTCDSKRACCEGLRCKLWCRKII-{Amide} |
| 380 | CyA-[Nle6,Lys(Pra-NPEG3)14]JzTx-V(1-29) | {H}-[CyA]YCQKW[Nle]WTCDSKR[KPPG3]CCEGLRCKLWCRKII-{Amide} |
| 381 | AllylG-[Nle6,Lys(Pra-NPEG3)14] JzTx-V(1-29) | {H}-[AllylG]YCQKW[Nle]WTCDSKR[KPPG3]CCEGLRCKLWCRKII-{Amide} |
| 382 | Abu-[Nle6,Lys(Pra-NPEG3)14]JzTx-V(1-29) | {H}-[Abu]YCQKW[Nle]WTCDSKR[KPPG3]CCEGLRCKLWCRKII-{Amide} |
| 383 | Nva-[Nle6,Lys(Pra-NPEG3)14]JzTx-V(1-29) | {H}-[Nva]YCQKW[Nle]WTCDSKR[KPPG3]CCEGLRCKLCRKII-{Amide} |
| 384 | Pra-[Nle6,Lys(Pra-NPEG3)14]JzTx-V(1-29) | {H}-[Pra]YCQKW[Nle]WTCDSKR[KPPG3]CCEGLRCKLWCRKII-{Amide} |
| 385 | CyA-[Nle6,Lys(Pra-NPEG3)17]JzTx-V(1-29) | {H}-[CyA]YCQKW[Nle]WTCDSKRACC[KPPG3]GLRCKLWCRKII-{Amide} |
| 386 | Pra-[Nle6,Lys(Pra-NPEG3)17]JzTx-V(1-29) | {H}-[Pra]YCQKW[Nle]WTCDSKRACC[KPPG3]GLRCKLWCRKII-{Amide} |
| 387 | Pra-[Nle6,Pra17]JzTx-V(1-29) | {H}-[Pra]YCQKW[Nle]WTCDSKRACC[Pra]GLRCKLWCRKII-{Amide} |
| 388 | CyA-[Nle6,Pra17]JzTx-V(1-29) | {H}-[CyA]YCQKW[Nle]WTCDSKRACC[Pra]GLRCKLWCRKII-{Amide} |
| 389 | CyA-[Nle6,Pra11]JzTx-V(1-29) | {H}-[CyA]YCQKW[Nle]WTCD[Pra]KRACCEGLRCKLWCRKII-{Amide} |
| 390 | Pra-[Nle6,Pra11]JzTx-V(1-29) | {H}-[Pra]YCQKW[Nle]WTCD[Pra]KRACCEGLRCKLWCRKII-{Amide} |
| 391 | CyA-[Pra1,Nle6]JzTx-V(1-29) | {H}-[CyA][Pra]CQKW[Nle]WTCDSKRACCEGLRCKLWCRKII-{Amide} |
| 392 | CyA-[Nle6,Lys(Pra)14,Glu28]JzTx-V(1-29) | {H}-[CyA]YCQKW[Nle]WTCDSKRK(Pra)CCEGLRCKLWCRKEI-{Amide} |
| 393 | CyA-[Nle6,Lys(Pra)14,Glu20]JzTx-V(1-29) | {H}-[CyA]YCQKW[Nle]WTCDSKRK(Pra)CCEGLECKLWCRKII-{Amide} |
| 394 | CyA-[Nle6,Lys(Pra)14,Glu20,Tyr28] JzTx-V(1-29) | {H}-[CyA]YCQKW[Nle]WTCDSKRK(Pra)CCEGLECKLWCRKYI-{Amide} |
| 395 | CyA-[Nle6,Pra17,Glu28]JzTx-V(1-29) | {H}-[CyA]YCQKW[Nle]WTCDSKRACC[Pra]GLRCKLWCRKEI-{Amide} |
| 396 | CyA-[Nle6,Pra17,Glu20]JzTx-V(1-29) | {H}-[CyA]YCQKW[Nle]WTCDSKRACC[Pra]GLECKLWCRKII-{Amide} |

TABLE 5-continued

Amino acid sequences of JzTx-V and JzTx-V peptide analogs.

| SEQ ID NO. | Designation | Amino Acid Sequence |
|---|---|---|
| 397 | CyA-[Nle6,Pra17,Glu20,Tyr28]JzTx-V(1-29) | {H}-[CyA]YCQKW[Nle]WTCDSKRACC[Pra]GLECKLWCRKYI-{Amide} |
| 398 | CyA-[Nle6,Lys(Pra)14]JzTx-V(1-29) | {H}-[CyA]YCQKW[Nle]WTCDSKRK(Pra)CCEGLRCKLWCRKII-{Amide} |
| 399 | AllylG-[Nle6,Lys(Pra)14]JzTx-V(1-29) | {H}-[AllylG]YCQKW[Nle]WTCDSKRK(Pra)CCEGLRCKLWCRKII-{Amide} |
| 400 | Abu-[Nle6,Lys(Pra)14]JzTx-V(1-29) | {H}-[Abu]YCQKW[Nle]WTCDSKRK(Pra)CCEGLRCKLWCRKII-{Amide} |
| 401 | Nva-[Nle6,Lys(Pra)14]JzTx-V(1-29) | {H}-[Nva]YCQKW[Nle]WTCDSKRK(Pra)CCEGLRCKLWCRKII-{Amide} |
| 402 | AllylG-[Nle6,Pra17]JzTx-V(1-29) | {H}-[AllylG]YCQKW[Nle]WTCDSKRACC[Pra]GLRCKLWCRKII-{Amide} |
| 403 | Nva-[Nle6,Pra17]JzTx-V(1-29) | {H}-[Nva]YCQKW[Nle]WTCDSKRACC[Pra]GLRCKLWCRKII-{Amide} |
| 404 | Nva-[Nle6,Lys(Pra)14]JzTx-V(1-29) | {H}-[Nva]YCQKW[Nle]WTCDSKRK(Pra)CCEGLRCKLWCRKII-{Amide} |
| 405 | Nva-[Nle6,Lys(Pra-NPEG3)14;JzTx-V(1-29) | {H}-[Nva]YCQKW[Nle]WTCDSKR[KPPG3]CCEGLRCKLWCRKII-{Amide] |
| 406 | [Nle6;Atz(NPeg 10)17;Glu28]JzTx-V(1-29) | {H}-YCQKW[Nle]WTCDSKRACC[Atz(PEG10)GLRCKLWCRKEI-{Amide} |
| 407 | [Atz(NPeg10)1;Nle6;Glu20]JzTx-V(1-29) | {H}-[Atz(PEG10)CQKW[Nle]WTCDSKRACCEGLECKLWCRKII-{Amide} |
| 408 | [Nle6;Atz(NPeg 10)11;Glu20]JzTx-V(1-29) | {H}-YCQKW[Nle]WTCD[Atz(PEG10)KRACCEGLECKLWCRKII-{Amide} |
| 409 | [Nle6;Atz(NPeg 10)17;Glu20]JzTx-V(1-29) | {H}-YCQKW[Nle]WTCDSKRACC[Atz(PEG10)GLECKLWCRKII-{Amide} |
| 410 | CyA-[Nle6,Lys(Atz(NPeg10)-NPEG3)14] JzTx-V(1-29) | {H}-[CyA]YCQKW[Nle]WTCDSKR[KAP3P10]CCEGLRCKLWCRKII-{Amide} |
| 411 | Nva-[Nle6;Lys(Pra)14;Glu28]JzTx-V(1-29) | {H}-[Nva]YCQKW[Nle]WTCDSKRK(Pra)CCEGLRCKLWCRKEI-{Amide} |
| 412 | Nva-[Leu6;Lys(Pra)14;Glu28]JzTx-V(1-29) | {H}-[Nva]YCQKWLWTCDSKRK(Pra)CCEGLRCKLWCRKEI-{Amide} |
| 413 | Nva-[Nle6;Lys(Pra)14;Glu20;Tyr28] JzTx-V(1-29) | {H}-[Nva]YCQKW[Nle]WTCDSKRK(Pra)CCEGLECKLWCRKYI-{Amide} |
| 414 | Nva-[Leu6;Lys(Pra)14;Glu20;Tyr28] JzTx-V(1-29) | {H}-[Nva]YCQKWLWTCDSKRK(Pra)CCEGLECKLWCRKYI-{Amide} |

TABLE 5-continued

Amino acid sequences of JzTx-V and JzTx-V peptide analogs.

| SEQ ID NO. | Designation | Amino Acid Sequence |
|---|---|---|
| 415 | Nva-[Nle6,Lys(Pra-NPEG3)14;Glu28] JzTx-V(1-29) | {H}-[Nva]YCQKW[Nle]WT CDSKR[KPPG3]CCEGLRCKL WCRKEI-{Amide} |
| 416 | Nva-[Leu6,Lys(Pra-NPEG3)14;Glu28] JzTx-V(1-29) | {H}-[Nva]YCQKWLWTCDSK R[KPPG3]CCEGLRCKLWCRK EI-{Amide} |
| 417 | Nva-[Nle6,Lys(Pra-NPEG3)14;Glu20;Tyr28] JzTx-V(1-29) | {H}-[Nva]YCQKW[Nle]WT CDSKR[KPPG3]CCEGLECKL WCRKYI-{Amide} |
| 418 | Nva-[Leu6,Lys(Pra-NPEG3)14;Glu20;Tyr28] JzTx-V(1-29) | {H}-[Nva]YCQKWLWTCDSK R[KPPG3]CCEGLECKLWCRK YI-{Amide} |
| 419 | Nva-[Nle6;Lys(Pra)14;Glu20,Trp29] JzTx-V(1 -29) | {H}-[Nva]YCQKW[Nle]WT CDSKRK(Pra)CCEGLECKLW CRKIW-{Amide} |
| 420 | Nva-[Leu6;Lys(Pra)14;Glu20;Trp29] JzTx-V(1-29) | {H}-[Nva]YCQKWLWTCDSK RK(Pra)CCEGLECKLWCRKI W-{Amide} |
| 421 | Nva-[Nle6,Lys(Pra-NPEG3)14;Glu20;Trp29] JzTx-V(1-29) | {H}-[Nva]YCQKW[Nle]WT CDSKR[KPPG3]CCEGLECKL WCRKIW-{Amide} |
| 422 | Nva-[Leu6,Lys(Pra-NPEG3)14;Glu20;Trp29] JzTx-V(1-29) | {H}-[Nva]YCQKWLWTCDSK R[KPPG3]CCEGLECKLWCRK IW-{Amide} |
| 423 | Nva-[Leu6;Lys(Pra)14]JzTx-V(1-29) | {H}-[Nva]YCQKWLWTCDSK RK(Pra)CCEGLRCKLWCRKI I-{Amide} |
| 424 | Nva-[Leu6,Lys(Pra-NPEG3)14]JzTx-V(1-29) | {H}-[Nva]YCQKWLWTCDSK R[KPPG3]CCEGLRCKLWCRK II-{Amide} |
| 425 | Pra-[Nle6]JzTx-V | {H}-[Pra]YCQKW[Nle]WT CDSKRACCEGLRCKLWCRKI I-{Amide} |
| 426 | Pra-[Nle6,Glu20,Trp29]JzTx-V | {H}-[Pra]YCQKW[Nle]WT CDSKRACCEGLECKLWCRKI W-{Amide} |
| 427 | Atz(PEG11-benzylthioacetamide)-[Nle6]JzTx-V(1 -29) | {H}-[Atz(PEG11-benzylthioacetamide)] YCQKW[Nle]WTCDSKRACCE GLRCKLWCRKII-{Amide} |
| 431 | Nva-[Nle6,Lys(Pra)14]JzTx-V(1-29) | {H}-[Nva]YCQKW[Nle]WT CDSKRK(Pra)CCEGLRCKLW CRKII{Amide} |
| 432 | Nva-[Nle6,Lys(Pra-NPEG3)14]JzTx-V(1-29) | {H}-[Nva]YCQKW[Nle]WT CDSKR[KPPG3]CCEGLRCKL WCRKII{Amide} |
| 433 | Nva-[Nle6,Lys(Atz(NPEG10))14]JzTx-V(1-29) | {H}-[Nva]YCQKW[Nle]WT CDSKR[KAtzNP10]CCEGLR CKLWCRKII{Amide} |
| 434 | Nva-[Nle6,Lys(Atz(NPEG10)-NPEG4)14] JzTx-V(1-29) | {H}-[Nva]YCQKW[Nle]WT CDSKR[KAP4P10]CCEGLRC KLWCRKII{Amide} |
| 435 | Nva-[Nle6;Lys(Pra)14;Glu28]JzTx-V(1-29) | {H}-[Nva]YCQKW[Nle]WT CDSKRK(Pra)CCEGLRCKLW CRKEI{Amide} |

TABLE 5-continued

Amino acid sequences of JzTx-V and JzTx-V peptide analogs.

| SEQ ID NO. | Designation | Amino Acid Sequence |
|---|---|---|
| 436 | Nva-[Nle6;Lys(Pra)14;Glu20;Tyr28] JzTx-V(1-29) | {H}-[Nva]YCQKW[Nle]WT CDSKRK(Pra)CCEGLECKLW CRKYI{Amide} |
| 437 | Nva-[Nle6;Lys(Pra)14;Glu20,Trp29] JzTx-V(1-29) | {H}-[Nva]YCQKW[Nle]WT CDSKRK(Pra)CCEGLECKLW CRKIW{Amide} |
| 438 | Nva-[Leu6,Lys(Pra)14]JzTx-V | {H}-[Nva]YCQKWLWTCDSK RK(Pra)CCEGLRCKLWCRKI I{Amide} |
| 439 | Nva-[Leu6;Lys(Pra)14;Glu28]JzTx-V(1-29) | {H}-[Nva]YCQKWLWTCDSK RK(Pra)CCEGLRCKLWCRKE I{Amide} |
| 440 | Nva-Leu6;Lys(Pra)14;Glu20;Tyr28] JzTx-V(1-29) | {H}-[Nva]YCQKWLWTCDSK RK(Pra)CCEGLECKLWCRKY I{Amide} |
| 441 | Nva-[Leu6;Lys(Pra)14;Glu20;Trp29] JzTx-V(1-29) | {H}-[Nva]YCQKWLWTCDSK RK(Pra)CCEGLECKLWCRKI W{Amide} |
| 442 | Nva-[Leu6,Lys(Pra-NPEG4)14;Glu28] JzTx-V(1-29) | {H}-[Nva]YCQKWLWTCDSK RK(Pra-NPEG4)CCEGLRCK LWCRKEI{Amide} |
| 443 | CyA-[Nle6,Atz(NPEG10)17,Glu28] JzTx-V(1-29) | {H}-[CyA]YCQKW[Nle]WT CDSKRACC[Atz(NPEG10)] GLRCKLWCRKEI{Amide} |
| 444 | CyA-[Nle6,Lys(Atz(NPEG10))14,Glu28] JzTx-V(1-29) | {H}-[CyA]YCQKW[Nle]WT CDSKRK(Atz(NPEG10))CC EGLRCKLWCRKEI{Amide} |
| 445 | CyA-[Nle6,Lys(Atz(NPEG10))14,Glu20,Tyr28] JzTx-V(1-29) | {H}-[CyA]YCQKW[Nle]WT CDSKRK(Atz(NPEG10))CC EGLECKLWCRKYI{Amide} |
| 446 | Nva-[Leu6;Lys(Atz(NPEG10))14PzTx-V(1-29) | {H}-[Nva]YCQKWLWTCDSK RK(Atz(NPEG10))CCEGLR CKLWCRKII{Amide} |
| 447 | Nva-[Leu6,Lys(Atz(NPEG10))14;Glu28]JzTx-V | {H}-[Nva]YCQKWLWTCDSK RK(Atz(NPEG10))CCEGLR CKLWCRKEI{Amide} |
| 448 | Nva-[Nle6;Lys(Atz(NPEG10))14;Glu28] JzTx-V(1-29) | {H}-[Nva]YCQKW[Nle]WT CDSKRK(Atz(NPEG10))CC EGLRCKLWCRKEI{Amide} |
| 449 | CyA-[Leu6,Lys(Pra)14,Glu28]JzTx-V(1-29) | {H}-[CyA]YCQKWLWTCDSK RK(Pra)CCEGLRCKLWCRKE I{Amide} |
| 450 | Pra-[Nle6;Glu28;Trp29]JzTx-V(1-29) | {H}-[Pra]YCQKW[Nle]WT CDSKRACCEGLRCKLWCRKEW {Amide} |
| 451 | CyA-[Nle6;Lys(Pra)14;Glu28;Trp29] JzTx-V(1-29) | {H}-[CyA]YCQKW[Nle]WT CDSKRK(Pra)CCEGLRCKLW CRKEW{Amide} |
| 452 | CyA-[Nle6;Pra17;Glu28;Trp29]JzTx-V(1-29) | {H}-[CyA]YCQKW[Nle]WT CDSKRACC[Pra]GLRCKLWC RKEW{Amide} |
| 453 | CyA-[Nle6;Lys(Pra)14;Trp29]JzTx-V(1-29) | {H}-[CyA]YCQKW[Nle]WT CDSKRK(Pra)CCEGLRCKLW CRKIW{Amide} |

TABLE 5-continued

Amino acid sequences of JzTx-V and JzTx-V peptide analogs.

| SEQ ID NO. | Designation | Amino Acid Sequence |
|---|---|---|
| 454 | CyA-[Nle6;Pra17;Trp29]JzTx-V(1-29) | {H}-[CyA]YCQKW[Nle]WT CDSKRACC[Pra]GLRCKLWC RKIW{Amide} |
| 455 | CyA-[Nle6;Lys(NPEG11)14;Glu28] JzTx-V(1-29) | {H}-{CyA}YCQKW{Nle}WT CDSKRK(NPeg11)CCEGLRC KLWCRKEI{Amide} |
| 456 | CyA-[Nle6;Lys(NPEG11)17;Glu28] JzTx-V(1-29) | {H}-[CyA]YCQKW[Nle]WT CDSKRACCK(NPeg11)GLRC KLWCRKEI{Amide} |
| 457 | Lys(NPEG11)-[Nle6;Glu28]JzTx-V(1-29) | {H}-K(NPeg11)YCQKW [Nle]WTCDSKRACCEGLRCK LWCRKEI{Amide} |
| 458 | CyA-[Nle6;Lys(NPEG11)14;Glu28;Trp29] JzTx-V(1-29) | {H}-[CyA]YCQKW[Nle]WT CDSKRK(NPeg11)CCEGLRC KLWCRKEW{Amide} |
| 459 | CyA-[Nle6;Lys(NPEG11)17;Glu28;Trp29] JzTx-V(1-29) | {H}-[CyA]YCQKW[Nle]WT CDSKRACCK(NPeg11)GLRC KLWCRKEW{Amide} |
| 460 | Lys(NPEG11)-[Nle6;Glu28;Trp29] JzTx-V(1-29) | {H}-K(NPeg11)YCQKW [Nle]WTCDSKRACCEGLRCK LWCRKEW{Amide} |
| 461 | Leu-[Nle6;Lys(NPEG11)14;Glu28] JzTx-V(1-29) | {H}-LYCQKW[Nle]WTCDSK RK(NPeg11)CCEGLRCKLWC RKEI{Amide} |
| 462 | Leu-[Nle6;Lys(NPEG11)17;Glu28] JzTx-V(1-29) | {H}-LYCQKW[Nle]WTCDSK RACCK(NPeg11)GLRCKLWC RKEI{Amide} |
| 463 | D-Leu-[Nle6;Lys(NPEG11)14;Glu28] JzTx-V(1-29) | {H}-lYCQKW[Nle]WTCDSK RK(NPeg11)CCEGLRCKLWC RKEI{Amide} |
| 464 | D-Leu-[Nle6;Lys(NPEG11)17;Glu28] JzTx-V(1-29) | {H}-lYCQKW[Nle]WTCDSK RACCK(NPeg11)GLRCKLWC RKEI{Amide} |
| 465 | NMeLeu-[Nle6;Lys(NPEG11)14;Glu28] JzTx-V(1-29) | {H}-[NMeLeu]YCQKW [Nle]WTCDSKRK(NPeg11) CCEGLRCKLWCRKEI {Amide} |
| 466 | NMeLeu-[Nle6;Lys(NPEG11)17;Glu28] JzTx-V(1-29) | {H}-[NMeLeu]YCQKW [Nle]WTCDSKRACCK (NPeg11)GLRCKLWCRKEI {Amide} |
| 467 | 1-Ach-[Nle6;Lys(NPEG11)14;Glu28] JzTx-V(1-29) | {H}-[1-Ach]YCQKW [Nle]WTCDSKRK (NPeg11)CCEGLRCKLWCR KEI{Amide} |
| 468 | 1-Ach-[Nle6;Lys(NPEG11)17;Glu28] JzTx-V(1-29) | {H}-[1-Ach]YCQKW [Nle]WTCDSKRACCK (NPeg11)GLRCKLWCRKEI {Amide} |
| 469 | Leu-Lys(NPEG11)-[Nle6;Glu28]JzTx-V(1-29) | {H}-LK(NPeg11)YCQKW [Nle]WTCDSKRACCEGLRC KLWCRKEI{Amide} |
| 470 | Leu-Nva-[Nle6;Lys(NPEG11)14;Glu28] JzTx-V(1-29) | {H}-L[Nva]YCQKW[Nle] WTCDSKRK(NPeg11)CCEG LRCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 471 | Leu-Nva-[Nle6;Lys(NPEG11)17;Glu28] JzTx-V(1-29) | {H}-L[Nva]YCQKW[Nle] WTCDSKRACCK(NPeg11)G LRCKLWCRKEI{Amide} |
| 472 | D-Leu-Nva-[Nle6;Lys(NPEG11)14;Glu28] JzTx-V(1-29) | {H}-l[Nva]YCQKW[Nle] WTCDSKRK(NPeg11)CCEG LRCKLWCRKEI{Amide} |
| 473 | D-Leu-Nva-[Nle6;Lys(NPEG11)17;Glu28] JzTx-V(1-29) | {H}-l[Nva]YCQKW[Nle] WTCDSKRACCK(NPeg11)G LRCKLWCRKEI{Amide} |
| 474 | Phe-Nva-[Nle6;Lys(NPEG11)14;Glu28] JzTx-V(1-29) | {H}-F[Nva]YCQKW[Nle] WTCDSKRK(NPeg11)CCEG LRCKLWCRKEI{Amide} |
| 475 | Phe-Nva-[Nle6;Lys(NPEG11)17;Glu28] JzTx-V(1-29) | {H}-F[Nva]YCQKW[Nle] WTCDSKRACCK(NPeg11)G LRCKLWCRKEI{Amide} |
| 476 | CyA-[Nle6;Lys(NPEG11)20;Trp29] JzTx-V(1-29) | {H}-[CyA]YCQKW[Nle]W TCDSKRACCEGLK (NPeg11)CKLWCRKIW {Amide} |
| 518 | CyA-[Pra1;Nle6;Glu28]JzTx-V(1-29) | {H}-[CyA][Pra]CQKW [Nle]WTCDSKRACCEGLRC KLWCRKEI{Amide} |
| 519 | CyA-[Nle6;Pra10;Glu28]JzTx-V(1-29) | {H}-[CyA]YCQKW[Nle]W TC[Pra]SKRACCEGLRCKL WCRKEI{Amide} |
| 520 | CyA-[Nle6;Pra11;Glu28]JzTx-V(1-29) | {H}-[CyA]YCQKW[Nle]W TCD[Pra]KRACCEGLRCKL WCRKEI{Amide} |
| 521 | CyA-[Nle6;Pra12;Glu28]JzTx-V(1-29) | {H}-[CyA]YCQKW[Nle]W TCDS[Pra]RACCEGLRCKL WCRKEI{Amide} |
| 522 | CyA-[Nle6;Pra13;Glu28]JzTx-V(1-29) | {H}-[CyA]YCQKW[Nle]W TCDSK[Pra]ACCEGLRCKL WCRKEI{Amide} |
| 523 | CyA-[Nle6;Pra18;Glu28]JzTx-V(1-29) | {H}-[CyA]YCQKW[Nle]W TCDSKRACCE[Pra]LRCKL WCRKEI{Amide} |
| 524 | CyA-[Nle6;Pra19;Glu28]JzTx-V(1-29) | {H}-[CyA]YCQKW[Nle]W TCDSKRACCEG[Pra]RCKL WCRKEI{Amide} |
| 525 | CyA-[Nle6;Pra20;Glu28]JzTx-V(1-29) | {H}-[CyA]YCQKW[Nle]W TCDSKRACCEGL[Pra]CKL WCRKEI{Amide} |
| 526 | CyA-[Pra1;Nle6;Glu28;Trp29]JzTx-V(1-29) | {H}-[CyA][Pra]CQKW [Nle]WTCDSKRACCEGLRC KLWCRKEW{Amide} |
| 527 | CyA-[Nle6;Pra10;Glu28;Trp29]JzTx-V(1-29) | {H}-[CyA]YCQKW[Nle]W TC[Pra]SKRACCEGLRCKL WCRKEW{Amide} |
| 545 | CyA-[Nle6;Lys(NPEG11)20]JzTx-V(1-29) | {H}-[CyA]YCQKW[Nle]W TCDSKRACCEGLK (NPeg11)CKLWCRKII {Amide} |
| 546 | CyA-[Nle6;Val8;Lys(NPEG11)14;Glu28] JzTx-V(1-29) | {H}-[CyA]YCQKW[Nle]W VCDSKRK(NPeg11)CCEGL RCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 547 | CyA-[Nle6;Val8;Lys(NPEG11)17;Glu28] JzTx-V(1-29) | {H}-[CyA]YCQKW[Nle]W VCDSKRACCK(NPeg11)GL RCKLWCRKEI{Amide} |
| 548 | CyA-[Leu3;Nle6;Lys(NPEG11)14;Glu28] JzTx-V(1-29) | {H}-[CyA]YCLKW[Nle]W TCDSKRK(NPeg11)CCEGL RCKLWCRKEI{Amide} |
| 549 | CyA-[Leu3;Nle6;Lys(NPEG11)17;Glu28] JzTx-V(1-29) | {H}-[CyA]YCLKW[Nle]W TCDSKRACCK(NPeg11)GL RCKLWCRKEI{Amide} |
| 550 | CyA-[Phe1;Nle6;Lys(NPEG11)14;Glu28] JzTx-V(1-29) | {H}-[CyA]FCQKW[Nle]W TCDSKRK(NPeg11)CCEGL RCKLWCRKEI{Amide} |
| 551 | CyA-[Phe1;Nle6;Lys(NPEG11)17;Glu28] JzTx-V(1-29) | {H}-[CyA]FCQKW[Nle]W TCDSKRACCK(NPeg11)GL RCKLWCRKEI{Amide} |
| 552 | CyA-[Nle4,6;Lys(NPEG11)14;Glu28] JzTx-V(1-29) | {H}-[CyA]YCQ[Nle]W [Nle]WTCDSKRK (NPeg11)CCEGLRCKLWCR KEI{Amide} |
| 553 | CyA-[Nle4,6;Lys(NPEG11)17;Glu28] JzTx-V(1-29) | {H}-[CyA]YCQ[Nle]W [Nle]WTCDSKRACCK (NPeg11)GLRCKLWCRKEI {Amide} |
| 554 | CyA-[Nle6,22;Lys(NPEG11)14;Glu28] JzTx-V(1-29) | {H}-[CyA]YCQKW[Nle]W TCDSKRK(NPeg11)CCEGL RC[Nle]LWCRKEI {Amide} |
| 555 | CyA-[Nle6,22;Lys(NPEG11)17;Glu28] JzTx-V(1-29) | {H}-[CyA]YCQKW[Nle]W TCDSKRACCK(NPeg11)GL RC[Nle]LWCRKEI {Amide} |
| 556 | CyA-[Nle6,27;Lys(NPEG11)14;Glu28] JzTx-V(1-29) | {H}-[CyA]YCQKW[Nle]W TCDSKRK(NPeg11)CCEGL RCKLWCR[Nle]EI {Amide} |
| 557 | CyA-[Nle6,27;Lys(NPEG11)17;Glu28] JzTx-V(1-29) | {H}-[CyA]YCQKW[Nle]W TCDSKRACCK(NPeg11)GL RCKLWCR[Nle]EI {Amide} |
| 558 | CyA-[Nle6;Lys(NPEG11)14,26;Glu28] JzTx-V(1-29) | {H}-[CyA]YCQKW[Nle]W TCDSKRK(NPeg11)CCEGL RCKLWCKKEI{Amide} |
| 559 | CyA-[Nle6;Lys(NPEG11)17,26;Glu28] JzTx-V(1-29) | {H}-[CyA]YCQKW[Nle]W TCDSKRACCK(NPeg11)GL RCKLWCKKEI{Amide} |
| 560 | CyA-[Nle6,12;Lys(NPEG11)14;Glu28] JzTx-V(1-29) | {H}-[CyA]YCQKW[Nle]W TCDS[Nle]RK(NPeg11)C CEGLRCKLWCRKEI {Amide} |
| 561 | CyA-[Nle6,12;Lys(NPEG11)17;Glu28] JzTx-V(1-29) | {H}-[CyA]YCQKW[Nle]W TCDS[Nle]RACCK (NPeg11)GLRCKLWCRKEI {Amide} |
| 562 | CyA-[Nle6;Phe14;Lys(NPEG11)17;Glu28] JzTx-V(1-29) | {H}-[CyA]YCQKW[Nle]W TCDSKRFCCK(NPeg11)GL RCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 563 | CyA-[Lys(NPEG11);Nle6;Glu28]JzTx-V(1-29) | {H}-[CyA]K(NPeg11)CQKW[Nle]WTCDSKRACCEGLRCKLWCRKEI{Amide} |
| 564 | CyA-[Nle6;Lys(NPEG11)10;Glu28]JzTx-V(1-29) | {H}-[CyA]YCQKW[Nle]WTCK(NPeg11)SKRACCEGLRCKLWCRKEI{Amide} |
| 565 | CyA-[Nle6;Lys(NPEG11)11;Glu28]JzTx-V(1-29) | {H}-[CyA]YCQKW[Nle]WTCDK(NPeg11)KRACCEGLRCKLWCRKEI{Amide} |
| 566 | CyA-[Nle6;Lys(NPEG11)12;Glu28]JzTx-V(1-29) | {H}-[CyA]YCQKW[Nle]WTCDSK(NPeg11)RACCEGLRCKLWCRKEI{Amide} |
| 567 | CyA-[Nle6;Lys(NPEG11)13;Glu28]JzTx-V(1-29) | {H}-[CyA]YCQKW[Nle]WTCDSKK(NPeg11)ACCEGLRCKLWCRKEI{Amide} |
| 568 | CyA-[Nle6;Lys(NPEG11)18;Glu28]JzTx-V(1-29) | {H}-[CyA]YCQKW[Nle]WTCDSKRACCEK(NPeg11)LRCKLWCRKEI{Amide} |
| 569 | CyA-[Nle6;Lys(NPEG11)19;Glu28]JzTx-V(1-29) | {H}-[CyA]YCQKW[Nle]WTCDSKRACCEGK(NPeg11)RCKLWCRKEI{Amide} |
| 570 | CyA-[Nle6;Lys(NPEG11)20;Glu28]JzTx-V(1-29) | {H}-[CyA]YCQKW[Nle]WTCDSKRACCEGLK(NPeg11)CKLWCRKEI{Amide} |
| 571 | Atz-[Nle6]JzTx-V | {H}-[Atz]YCQKW[Nle]WTCDSKRACCEGLRCKLWCRKII-{Amide} |
| 572 | Atz-[Nle6]JzTx-V | {H}-[Atz]YCQKW[Nle]WTCDSKRACCEGLRCKLWCRKII-{Amide} |
| 573 | CyA-[Nle6;Pra11;Glu28;Trp29]JzTx-V(1-29) | {H}-[CyA]YCQKW[Nle]WTCD[Pra]KRACCEGLRCKLWCRKEW{Amide} |
| 574 | CyA-[Nle6;Pra12;Glu28;Trp29]JzTx-V(1-29) | {H}-[CyA]YCQKW[Nle]WTCDS[Pra]RACCEGLRCKLWCRKEW{Amide} |
| 575 | CyA-[Nle6;Pra13;Glu28;Trp29]JzTx-V(1-29) | {H}-[CyA]YCQKW[Nle]WTCDSK[Pra]ACCEGLRCKLWCRKEW{Amide} |
| 576 | CyA-[Nle6;Pra18;Glu28;Trp29]JzTx-V(1-29) | {H}-[CyA]YCQKW[Nle]WTCDSKRACCE[Pra]LRCKLWCRKEW{Amide} |
| 577 | CyA-[Nle6;Pra19;Glu28;Trp29]JzTx-V(1-29) | {H}-[CyA]YCQKW[Nle]WTCDSKRACCEG[Pra]RCKLWCRKEW{Amide} |
| 578 | CyA-[Nle6;Pra20;Glu28;Trp29]JzTx-V(1-29) | {H}-[CyA]YCQKW[Nle]WTCDSKRACCEGL[Pra]CKLWCRKEW{Amide} |
| 579 | CyA-[Pra1;Nle6]JzTx-V(1-29) | {H}-[CyA][Pra]CQKW[Nle]WTCDSKRACCEGLRCKLWCRKII{Amide} |
| 580 | Nva-[Pra1;Nle6]JzTx-V(1-29) | {H}-[Nva][Pra]CQKW[Nle]WTCDSKRACCEGLRCKLWCRKII{Amide} |

TABLE 5-continued

Amino acid sequences of JzTx-V and JzTx-V peptide analogs.

| SEQ ID NO. | Designation | Amino Acid Sequence |
|---|---|---|
| 581 | Leu-[Pra1;Nle6]JzTx-V(1-29) | {H}-L[Pra]CQKW[Nle]W TCDSKRACCEGLRCKLWCRK II{Amide} |
| 582 | D-Leu-[Pra1;Nle6]JzTx-V(1-29) | {H}-l[Pra]CQKW[Nle]W TCDSKRACCEGLRCKLWCRK II{Amide} |
| 583 | Leu-Leu-[Pra1;Nle6]JzTx-V(1-29) | {H}-LL[Pra]CQKW[Nle] WTCDSKRACCEGLRCKLWCR KII{Amide} |
| 584 | CyA-[Pra1;Leu6]JzTx-V(1-29) | {H}-[CyA][Pra]CQKWLW TCDSKRACCEGLRCKLWCRK II{Amide} |
| 585 | Nva-[Pra1;Leu6]JzTx-V(1-29) | {H}-[Nva][Pra]CQKWLW TCDSKRACCEGLRCKLWCRK II{Amide} |
| 586 | Leu-[Pra1;Leu6]JzTx-V(1-29) | {H}-L[Pra]CQKWLWTCDS KRACCEGLRCKLWCRKII {Amide} |
| 587 | D-Leu-[Pra1;Leu6]JzTx-V(1-29) | {H}-l[Pra]CQKWLWTCDS KRACCEGLRCKLWCRKII {Amide} |
| 588 | Leu-Leu-[Pra1;Leu6]JzTx-V(1-29) | {H}-LL[Pra]CQKWLWTCD SKRACCEGLRCKLWCRKII {Amide} |
| 595 | Pra-[Nle6,Trp29]JzTx-V(1-29) | {H}-[Pra]YCQKW[Nle]W TCDSKRACCEGLRCKLWCRK IW{Amide} |
| 596 | Pra-[Nle6;Ala28]JzTx-V(1-29)-FreeAcid | {H}-[Pra]YCQKW[Nle]W TCDSKRACCEGLRCKLWCRK AI{FreeAcid} |
| 597 | Pra-[Nle6;Asp28]JzTx-V(1-29)-FreeAcid | {H}-[Pra]YCQKW[Nle]W TCDSKRACCEGLRCKLWCRK DI{FreeAcid} |
| 598 | Pra-[Nle6;Phe28]JzTx-V(1-29)-FreeAcid | {H}-[Pra]YCQKW[Nle]W TCDSKRACCEGLRCKLWCRK FI{FreeAcid} |
| 599 | Pra-[Nle6;Gly28]JzTx-V(1-29)-FreeAcid | {H}-[Pra]YCQKW[Nle]W TCDSKRACCEGLRCKLWCRK GI{FreeAcid} |
| 600 | Pra-[Nle6;His28]JzTx-V(1-29)-FreeAcid | {H}-[Pra]YCQKW[Nle]W TCDSKRACCEGLRCKLWCRK HI{FreeAcid} |
| 601 | Pra-[Nle6;Lys28]JzTx-V(1-29)-FreeAcid | {H}-[Pra]YCQKW[Nle]W TCDSKRACCEGLRCKLWCRK KI{FreeAcid} |
| 602 | Pra-[Nle6;Leu28]JzTx-V(1-29)-FreeAcid | {H}-[Pra]YCQKW[Nle]W TCDSKRACCEGLRCKLWCRK LI{FreeAcid} |
| 603 | Pra-[Nle6,28]JzTx-V(1-29)-FreeAcid | {H}-[Pra]YCQKW[Nle]W TCDSKRACCEGLRCKLWCRK [Nle]I{FreeAcid} |
| 604 | Pra-[Nle6;Asn28]JzTx-V(1-29)-FreeAcid | {H}-[Pra]YCQKW[Nle]W TCDSKRACCEGLRCKLWCRK NI{FreeAcid} |

TABLE 5-continued

Amino acid sequences of JzTx-V and JzTx-V peptide analogs.

| SEQ ID NO. | Designation | Amino Acid Sequence |
|---|---|---|
| 605 | Pra-[Nle6;Pro28]JzTx-V(1-29)-FreeAcid | {H}-[Pra]YCQKW[Nle]W TCDSKRACCEGLRCKLWCRK PI{FreeAcid} |
| 606 | Pra-[Nle6;Gln28]JzTx-V(1-29)-FreeAcid | {H}-[Pra]YCQKW[Nle]W TCDSKRACCEGLRCKLWCRK QI{FreeAcid} |
| 607 | Pra-[Nle6;Arg28]JzTx-V(1-29)-FreeAcid | {H}-[Pra]YCQKW[Nle]W TCDSKRACCEGLRCKLWCRK RI{FreeAcid} |
| 608 | Pra-[Nle6;Ser28]JzTx-V(1-29)-FreeAcid | {H}-[Pra]YCQKW[Nle]W TCDSKRACCEGLRCKLWCRK SI{FreeAcid} |
| 609 | Pra-[Nle6;Thr28]JzTx-V(1-29)-FreeAcid | {H}-[Pra]YCQKW[Nle]W TCDSKRACCEGLRCKLWCRK TI{FreeAcid} |
| 610 | Pra-[Nle6;Val28]JzTx-V(1-29)-FreeAcid | {H}-[Pra]YCQKW[Nle]W TCDSKRACCEGLRCKLWCRK VI{FreeAcid} |
| 611 | Pra-[Nle6;Trp28]JzTx-V(1-29)-FreeAcid | {H}-[Pra]YCQKW[Nle]W TCDSKRACCEGLRCKLWCRK WI{FreeAcid} |
| 612 | Pra-[Nle6;1-Nal28]JzTx-V(1-29)-FreeAcid | {H}-[Pra]YCQKW[Nle]W TCDSKRACCEGLRCKLWCRK {1-Nal]I{FreeAcid} |
| 613 | Pra-[Nle6;Ala20]JzTx-V(1-29)-FreeAcid | {H}-[Pra]YCQKW[Nle]W TCDSKRACCEGLACKLWCRK II{FreeAcid} |
| 614 | Pra-[Nle6;Asp20]JzTx-V(1-29)-FreeAcid | {H}-[Pra]YCQKW[Nle]W TCDSKRACCEGLDCKLWCRK II{FreeAcid} |
| 615 | Pra-[Nle6;Glu20]JzTx-V(1-29)-FreeAcid | {H}-W[Pra]YCQKW[Nle] WTCDSKRACCEGLECKLWCR KII{FreeAcid} |
| 616 | Pra-[Nle6;Phe20]JzTx-V(1-29)-FreeAcid | {H}-W[Pra]YCQKW[Nle] WTCDSKRACCEGLFCKLWCR KII{FreeAcid} |
| 617 | Pra-[Nle6;Gly20]JzTx-V(1-29)-FreeAcid | {H}-[Pra]YCQKW[Nle]W TCDSKRACCEGLGCKLWCRK II{FreeAcid} |
| 618 | Pra-[Nle6;His20]JzTx-V(1-29)-FreeAcid | {H}-[Pra]YCQKW[Nle]W TCDSKRACCEGLHCKLWCRK II{FreeAcid} |
| 619 | Pra-[Nle6;Ile20]JzTx-V(1-29)-FreeAcid | {H}-W[Pra]YCQKW[Nle] WTCDSKRACCEGLICKLWCR KII{FreeAcid} |
| 620 | Pra-[Nle6;Lys20]JzTx-V(1-29)-FreeAcid | {H}-[Pra]YCQKW[Nle]W TCDSKRACCEGLKCKLWCRK II{FreeAcid} |
| 621 | Pra-[Nle6;Leu20]JzTx-V(1-29)-FreeAcid | {H}-W[Pra]YCQKW[Nle] WTCDSKRACCEGLLCKLWCR KII{FreeAcid} |
| 622 | Pra-[Nle6,20]JzTx-V(1-29)-FreeAcid | {H}-[Pra]YCQKW[Nle]W TCDSKRACCEGL[Nle]CKL WCRKII{FreeAcid} |

TABLE 5-continued

Amino acid sequences of JzTx-V and JzTx-V peptide analogs.

| SEQ ID NO. | Designation | Amino Acid Sequence |
|---|---|---|
| 623 | Pra-[Nle6;Asn20]JzTx-V(1-29)-FreeAcid | {H}-[Pra]YCQKW[Nle]W TCDSKRACCEGLNCKLWCRK II{FreeAcid} |
| 624 | Pra-[Nle6;Pro20]JzTx-V(1-29)-FreeAcid | {H}-[Pra]YCQKW[Nle]W TCDSKRACCEGLPCKLWCRK II{FreeAcid} |
| 625 | Pra-[Nle6;Gln20]JzTx-V(1-29)-FreeAcid | {H}-[Pra]YCQKW[Nle]W TCDSKRACCEGLQCKLWCRK II{FreeAcid} |
| 626 | Pra-[Nle6;Ser20]JzTx-V(1-29)-FreeAcid | {H}-[Pra]YCQKW[Nle]W TCDSKRACCEGLSCKLWCRK II{FreeAcid} |
| 627 | Pra-[Nle6;Thr20]JzTx-V(1-29)-FreeAcid | {H}-[Pra]YCQKW[Nle]W TCDSKRACCEGLTCKLWCRK II{FreeAcid} |
| 628 | Pra-[Nle6;Val20]JzTx-V(1-29)-FreeAcid | {H}-[Pra]YCQKW[Nle]W TCDSKRACCEGLVCKLWCRK II{FreeAcid} |
| 629 | Pra-[Nle6;Trp20]JzTx-V(1-29)-FreeAcid | {H}-[Pra]YCQKW[Nle]W TCDSKRACCEGLWCKLWCRK II{FreeAcid} |
| 630 | Pra-[Nle6;Tyr20]JzTx-V(1-29)-FreeAcid | {H}-[Pra]YCQKW[Nle]W TCDSKRACCEGLYCKLWCRK II{FreeAcid} |
| 631 | Pra-[Nle6;1-Nal20]JzTx-V(1-29)-FreeAcid | {H}-[Pra]YCQKW[Nle]W TCDSKRACCEGL[1-Nal]C KLWCRKII{FreeAcid} |
| 632 | Pra-[Nle6;Asp20;Glu28]JzTx-V(1-29)-FreeAcid | {H}-[Pra]YCQKW[Nle]W TCDSKRACCEGLDCKLWCRK EI{FreeAcid} |
| 633 | Pra-[Nle6;Glu20,28]JzTx-V(1-29)-FreeAcid | {H}-W[Pra]YCQKW[Nle] WTCDSKRACCEGLECKLWCR KEI{FreeAcid} |
| 634 | Pra-[Nle6;Phe20;Glu28]JzTx-V(1-29)-FreeAcid | {H}-[Pra]YCQKW[Nle]W TCDSKRACCEGLFCKLWCRK EI{FreeAcid} |
| 635 | Pra-[Nle6;Gly20;Glu28]JzTx-V(1-29)-FreeAcid | {H}-[Pra]YCQKW[Nle]W TCDSKRACCEGLGCKLWCRK EI{FreeAcid} |
| 636 | Pra-[Nle6;His20;Glu28]JzTx-V(1-29)-FreeAcid | {H}-[Pra]YCQKW[Nle]W TCDSKRACCEGLHCKLWCRK EI{FreeAcid} |
| 637 | Pra-[Nle6;Ile20;Glu28]JzTx-V(1-29)-FreeAcid | {H}-W[Pra]YCQKW[Nle] WTCDSKRACCEGLICKLWCR KEI{FreeAcid} |
| 638 | Pra-[Nle6;Leu20;Glu28]JzTx-V(1-29)-FreeAcid | {H}-[Pra]YCQKW[Nle]W TCDSKRACCEGLLCKLWCRK EI{FreeAcid} |
| 639 | Pra-[Nle6,20;Glu28]JzTx-V(1-29)-FreeAcid | {H}-W[Pra]YCQKW[Nle] WTCDSKRACCEGL[Nle]CK LWCRKEI{FreeAcid} |
| 640 | Pra-[Nle6;Asn20;Glu28]JzTx-V(1-29)-FreeAcid | {H}-[Pra]YCQKW[Nle]W TCDSKRACCEGLNCKLWCRK EI{FreeAcid} |

TABLE 5-continued

Amino acid sequences of JzTx-V and JzTx-V peptide analogs.

| SEQ ID NO. | Designation | Amino Acid Sequence |
|---|---|---|
| 641 | Pra-[Nle6;Pro20;Glu28]JzTx-V(1-29)-FreeAcid | {H}-[Pra]YCQKW[Nle]WTCDSKRACCEGLPCKLWCRKEI{FreeAcid} |
| 642 | Pra-[Nle6;Gln20;Glu28]JzTx-V(1-29)-FreeAcid | {H}-[Pra]YCQKW[Nle]WTCDSKRACCEGLQCKLWCRKEI{FreeAcid} |
| 643 | Pra-[Nle6;Ser20;Glu28]JzTx-V(1-29)-FreeAcid | {H}-[Pra]YCQKW[Nle]WTCDSKRACCEGLSCKLWCRKEI{FreeAcid} |
| 644 | Pra-[Nle6;Thr20;Glu28]JzTx-V(1-29)-FreeAcid | {H}-[Pra]YCQKW[Nle]WTCDSKRACCEGLTCKLWCRKEI{FreeAcid} |
| 645 | Pra-[Nle6;Val20;Glu28]JzTx-V(1-29)-FreeAcid | {H}-[Pra]YCQKW[Nle]WTCDSKRACCEGLVCKLWCRKEI{FreeAcid} |
| 646 | Pra-[Nle6;Trp20;Glu28]JzTx-V(1-29)-FreeAcid | {H}-[Pra]YCQKW[Nle]WTCDSKRACCEGLWCKLWCRKEI{FreeAcid} |
| 647 | Pra-[Nle6;Tyr20;Glu28]JzTx-V(1-29)-FreeAcid | {H}-[Pra]YCQKW[Nle]WTCDSKRACCEGLYCKLWCRKEI{FreeAcid} |
| 648 | Pra-[Nle6;1-Nal20;Glu28]JzTx-V(1-29)-FreeAcid | {H}-[Pra]YCQKW[Nle]WTCDSKRACCEGL[1-Nal]CKLWCRKEI{FreeAcid} |
| 649 | Pra-[Nle6;Ala28]JzTx-V(1-29) | {H}-[Pra]YCQKW[Nle]WTCDSKRACCEGLRCKLWCRKAI{Amide} |
| 650 | Pra-[Nle6;Phe28]JzTx-V(1-29) | {H}-[Pra]YCQKW[Nle]WTCDSKRACCEGLRCKLWCRKFI{Amide} |
| 651 | Pra-[Nle6;Gly28]JzTx-V(1-29) | {H}-[Pra]YCQKW[Nle]WTCDSKRACCEGLRCKLWCRKGI{Amide} |
| 652 | Pra-[Nle6;His28]JzTx-V(1-29) | {H}-[Pra]YCQKW[Nle]WTCDSKRACCEGLRCKLWCRKHI{Amide} |
| 653 | Pra-[Nle6;Tyr28]JzTx-V(1-29) | {H}-[Pra]YCQKW[Nle]WTCDSKRACCEGLRCKLWCRKYI{Amide} |
| 654 | Pra-[Nle6;Lys28]JzTx-V(1-29) | {H}-[Pra]YCQKW[Nle]WTCDSKRACCEGLRCKLWCRKKI{Amide} |
| 655 | Pra-[Nle6;Leu28]JzTx-V(1-29) | {H}-[Pra]YCQKW[Nle]WTCDSKRACCEGLRCKLWCRKLI{Amide} |
| 656 | Pra-[Nle6;Asn28]JzTx-V(1-29) | {H}-[Pra]YCQKW[Nle]WTCDSKRACCEGLRCKLWCRKNI{Amide} |
| 657 | Pra-[Nle6;Pro28]JzTx-V(1-29) | {H}-[Pra]YCQKW[Nle]WTCDSKRACCEGLRCKLWCRKPI{Amide} |
| 658 | Pra-[Nle6;Arg28]JzTx-V(1-29) | {H}-[Pra]YCQKW[Nle]WTCDSKRACCEGLRCKLWCRKRI{Amide} |

TABLE 5-continued

Amino acid sequences of JzTx-V and JzTx-V peptide analogs.

| SEQ ID NO. | Designation | Amino Acid Sequence |
|---|---|---|
| 659 | Pra-[Nle6;Ser28]JzTx-V(1-29) | {H}-[Pra]YCQKW[Nle]WTCDSKRACCEGLRCKLWCRKSI{Amide} |
| 660 | Pra-[Nle6;Thr28]JzTx-V(1-29) | {H}-[Pra]YCQKW[Nle]WTCDSKRACCEGLRCKLWCRKTI{Amide} |
| 661 | Pra-[Nle6;Val28]JzTx-V(1-29) | {H}-[Pra]YCQKW[Nle]WTCDSKRACCEGLRCKLWCRKVI{Amide} |
| 662 | Pra-[Nle6;Trp28]JzTx-V(1-29) | {H}-[Pra]YCQKW[Nle]WTCDSKRACCEGLRCKLWCRKWI{Amide} |
| 663 | Pra-[Nle6;1-Nal28]JzTx-V(1-29) | {H}-[Pra]YCQKW[Nle]WTCDSKRACCEGLRCKLWCRK[1-Nal]I{Amide} |
| 664 | Pra-[Nle6,28]JzTx-V(1-29) | {H}-[Pra]YCQKW[Nle]WTCDSKRACCEGLRCKLWCRK[Nle]I{Amide} |
| 665 | Pra-[Nle6;Gln28]JzTx | {H}-[Pra]YCQKW[Nle]WTCDSKRACCEGLRCKLWCRKQI{Amide} |
| 666 | Pra-[Nle6;Ala20]JzTx-V(1-29) | {H}-[Pra]YCQKW[Nle]WTCDSKRACCEGLACKLWCRKII{Amide} |
| 667 | Pra-[Nle6;Asp20]JzTx-V(1-29) | {H}-[Pra]YCQKW[Nle]WTCDSKRACCEGLDCKLWCRKII{Amide} |
| 668 | Pra-[Nle6;Phe20]JzTx-V(1-29) | {H}-W[Pra]YCQKW[Nle]WTCDSKRACCEGLFCKLWCRKII{Amide} |
| 669 | Pra-[Nle6;Gly20]JzTx-V(1-29) | {H}-[Pra]YCQKW[Nle]WTCDSKRACCEGLGCKLWCRKII{Amide} |
| 670 | Pra-[Nle6;His20]JzTx-V(1-29) | {H}-[Pra]YCQKW[Nle]WTCDSKRACCEGLHCKLWCRKII{Amide} |
| 671 | Pra-[Nle6;Ile20]JzTx-V(1-29) | {H}-[Pra]YCQKW[Nle]WTCDSKRACCEGLICKLWCRKII{Amide} |
| 672 | Pra-[Nle6;Lys20]JzTx-V(1-29) | {H}-[Pra]YCQKW[Nle]WTCDSKRACCEGLKCKLWCRKII{Amide} |
| 673 | Pra-[Nle6;Leu20]JzTx-V(1-29) | {H}-W[Pra]YCQKW[Nle]WTCDSKRACCEGLLCKLWCRKII{Amide} |
| 674 | Pra-[Nle6,20]JzTx-V(1-29) | {H}-[Pra]YCQKW[Nle]WTCDSKRACCEGL[Nle]CKLWCRKII{Amide} |
| 675 | Pra-[Nle6;Asn20]JzTx-V(1-29) | {H}-[Pra]YCQKW[Nle]WTCDSKRACCEGLNCKLWCRKII{Amide} |
| 676 | Pra-[Nle6;Pro20]JzTx-V(1-29) | {H}-[Pra]YCQKW[Nle]WTCDSKRACCEGLPCKLWCRKII{Amide} |

TABLE 5-continued

Amino acid sequences of JzTx-V and JzTx-V peptide analogs.

| SEQ ID NO. | Designation | Amino Acid Sequence |
|---|---|---|
| 677 | Pra-[Nle6;Gln20]JzTx-V(1-29) | {H}-[Pra]YCQKW[Nle]W TCDSKRACCEGLQCKLWCRK II{Amide} |
| 678 | Pra-[Nle6;Ser20]JzTx-V(1-29) | {H}-[Pra]YCQKW[Nle]W TCDSKRACCEGLSCKLWCRK II{Amide} |
| 679 | Pra-[Nle6;Thr20]JzTx-V(1-29) | {H}-W[Pra]YCQKW[Nle] WTCDSKRACCEGLTCKLWCR KII{Amide} |
| 680 | Pra-[Nle6;Val20]JzTx-V(1-29) | {H}-[Pra]YCQKW[Nle]W TCDSKRACCEGLVCKLWCRK II{Amide} |
| 681 | Pra-[Nle6;Trp20]JzTx-V(1-29) | {H}-[Pra]YCQKW[Nle]W TCDSKRACCEGLWCKLWCRK II{Amide} |
| 682 | Pra-[Nle6;Tyr20]JzTx-V(1-29) | {H}-[Pra]YCQKW[Nle]W TCDSKRACCEGLYCKLWCRK II{Amide} |
| 683 | Pra-[Nle6;1-Nal20]JzTx-V(1-29) | {H}-[Pra]YCQKW[Nle]W TCDSKRACCEGL[1-Nal]C KLWCRKII{Amide} |
| 684 | Pra-[Nle6;Asp20;Glu28]JzTx-V(1-29) | {H}-[Pra]YCQKW[Nle]W TCDSKRACCEGLDCKLWCRK EI{Amide} |
| 685 | Pra-[Nle6;Glu20,28]JzTx-V(1-29) | {H}-W[Pra]YCQKW[Nle] WTCDSKRACCEGLECKLWCR KEI{Amide} |
| 686 | Pra-[Nle6;Phe20;Glu28]JzTx-V(1-29) | {H}-[Pra]YCQKW[Nle]W TCDSKRACCEGLFCKLWCRK EI{Amide} |
| 687 | Pra-[Nle6;Gly20;Glu28]JzTx-V(1-29) | {H}-[Pra]YCQKW[Nle]W TCDSKRACCEGLGCKLWCRK EI{Amide} |
| 688 | Pra-[Nle6;His20;Glu28]JzTx-V(1-29) | {H}-[Pra]YCQKW[Nle]W TCDSKRACCEGLHCKLWCRK EI{Amide} |
| 689 | Pra-[Nle6;Ile20;Glu28]JzTx-V(1-29) | {H}-W[Pra]YCQKW[Nle] WTCDSKRACCEGLICKLWCR KEI{Amide} |
| 690 | Pra-[Nle6;Leu20;Glu28]JzTx-V(1-29) | {H}-[Pra]YCQKW[Nle]W TCDSKRACCEGLLCKLWCRK EI{Amide} |
| 691 | Pra-[Nle6,20;Glu28]JzTx-V(129) | {H}-W[Pra]YCQKW[Nle] WTCDSKRACCEGL[Nle]CK LWCRKEI{Amide} |
| 692 | Pra-[Nle6;Asn20;Glu28]JzTx-V(1-29) | {H}-[Pra]YCQKW[Nle]W TCDSKRACCEGLNCKLWCRK EI{Amide} |
| 693 | Pra-[Nle6;Pro20;Glu28]JzTx-V(1-29) | {H}-[Pra]YCQKW[Nle]W TCDSKRACCEGLPCKLWCRK EI{Amide} |
| 694 | Pra-[Nle6;Gln20;Glu28]JzTx-V(1-29) | {H}-[Pra]YCQKW[Nle]W TCDSKRACCEGLQCKLWCRK EI{Amide} |

TABLE 5-continued

Amino acid sequences of JzTx-V and JzTx-V peptide analogs.

| SEQ ID NO. | Designation | Amino Acid Sequence |
|---|---|---|
| 695 | Pra-[Nle6;Ser20;Glu28]JzTx-V(1-29) | {H}-[Pra]YCQKW[Nle]W TCDSKRACCEGLSCKLWCRK EI{Amide} |
| 696 | Pra-[Nle6;Thr20;Glu28]JzTx-V(1-29) | {H}-[Pra]YCQKW[Nle]W TCDSKRACCEGLTCKLWCRK EI{Amide} |
| 697 | Pra-[Nle6;Val20;Glu28]JzTx-V(1-29) | {H}-[Pra]YCQKW[Nle]W TCDSKRACCEGLVCKLWCRK EI{Amide} |
| 698 | Pra-[Nle6;Trp20;Glu28]JzTx-V(1-29) | {H}-[Pra]YCQKW[Nle]W TCDSKRACCEGLWCKLWCRK EI{Amide} |
| 699 | Pra-[Nle6;Tyr20;Glu28]JzTx-V(1-29) | {H}-[Pra]YCQKW[Nle]W TCDSKRACCEGLYCKLWCRK EI{Amide} |
| 700 | Pra-[Nle6;1-Nal20;Glu28]JzTx-V(1-29) | {H}-[Pra]YCQKW[Nle]W TCDSKRACCEGL[1-Nal]C KLWCRKEI{Amide} |
| 701 | [Y3-I1;Nle6;Glu28]JzTx-V(1-29) | {H}-[Y3-I]CQKW[Nle]W TCDSKRACCEGLRCKLWCRK EI{Amide} |
| 702 | [Y3-I1;Nle6;1-Nal7,24;Glu28]JzTx-V(1-29) | {H}-[Y3-I]CQKW[Nle] [1-Nal]TCDSKRACCEGLT CKL[1-Nal]CRKEI {Amide} |
| 703 | Pra-[Nle6;Ala19;Glu28]JzTx-V(1-29) | {H}-[Pra]YCQKW[Nle]W TCDSKRACCEGARCKLWCRK EI{Amide} |
| 704 | Pra-[Nle6;Lys19;Glu28]JzTx-V(1-29) | {H}-[Pra]YCQKW[Nle]W TCDSKRACCEGKRCKLWCRK EI{Amide} |
| 705 | Pra-[Nle6;Arg19;Glu28]JzTx-V(1-29) | {H}-[Pra]YCQKW[Nle]W TCDSKRACCEGRRCKLWCRK EI{Amide} |
| 706 | Pra-[Nle6;1-Nal19;Glu28]JzTx-V(1-29) | {H}-[Pra]YCQKW[Nle]W TCDSKRACCEG[1-Nal]RC KLWCRKEI{Amide} |
| 707 | Glu-Pra-[Nle6;Glu28]JzTx-V(1-29) | {H}-E[Pra]YCQKW[Nle] WTCDSKRACCEGLRCKLWCR KEI{Amide} |
| 708 | Glu-[Nle6;Glu28]JzTx-V(1-29) | {H}-EYCQKW[Nle]WTCDS KRACCEGLRCKLWCRKEI {Amide} |
| 709 | Pra-[Glu1,28;Nle6]JzTx-V(1-29) | {H}-[Pra]ECQKW[Nle]W TCDSKRACCEGLRCKLWCRK EI{Amide} |
| 710 | Pra-[Glu3,28;Nle6]JzTx-V(1-29) | {H}-W[Pra]YCEKW[Nle] WTCDSKRACCEGLRCKLWCR KEI{Amide} |
| 711 | Pra-[Glu4,28;Nle6]JzTx-V(1-29) | {H}-W[Pra]YCQEW[Nle] WTCDSKRACCEGLRCKLWCR KEI{Amide} |
| 712 | Pra-[Nle6;Glu8,28]JzTx-V(1-29) | {H}-[Pra]YCQKW[Nle]W ECDSKRACCEGLRCKLWCRK EI{Amide} |

TABLE 5-continued

Amino acid sequences of JzTx-V and JzTx-V peptide analogs.

| SEQ ID NO. | Designation | Amino Acid Sequence |
| --- | --- | --- |
| 713 | Pra-[Nle6;Glu10,28]JzTx-V(1-29) | {H}-W[Pra]YCQKW[Nle] WTCESKRACCEGLRCKLWCR KEI{Amide} |
| 714 | Pra-[Nle6;Glu11,28]JzTx-V(1-29) | {H}-W[Pra]YCQKW[Nle] WTCDEKRACCEGLRCKLWCR KEI{Amide} |
| 715 | Pra-[Nle6;Glu12,28]JzTx-V(1-29) | {H}-[Pra]YCQKW[Nle]W TCDSERACCEGLRCKLWCRK EI{Amide} |
| 716 | Pra-[Nle6;Glu13,28]JzTx-V(1-29) | {H}-W[Pra]YCQKW[Nle] WTCDSKEACCEGLRCKLWCR KEI{Amide} |
| 717 | Pra-[Nle6;Glu14,28]JzTx-V(1-29) | {H}-[Pra]YCQKW[Nle]W TCDSKRECCEGLRCKLWCRK EI{Amide} |
| 718 | Pra-[Nle6;Lys17;Glu28]JzTx-V(1-29) | {H}-[Pra]YCQKW[Nle]W TCDSKRACCKGLRCKLWCRK EI{Amide} |
| 719 | Pra-[Nle6;Glu18,28]JzTx-V(1-29) | {H}-[Pra]YCQKW[Nle]W TCDSKRACCEELRCKLWCRK EI{Amide} |
| 720 | Pra-[Nle6;Glu19,28]JzTx-V(1-29) | {H}-[Pra]YCQKW[Nle]W TCDSKRACCEGERCKLWCRK EI{Amide} |
| 721 | Pra-[Nle6;Lys20;Glu28]JzTx-V(1-29) | {H}-[Pra]YCQKW[Nle]W TCDSKRACCEGLKCKLWCRK EI{Amide} |
| 722 | Pra-[Nle6;Glu22,28]JzTx-V(1-29) | {H}-W[Pra]YCQKW[Nle] WTCDSKRACCEGLRCELWCR KEI{Amide} |
| 723 | Pra-[Nle6;Asp28]JzTx-V(1-29) | {H}-[Pra]YCQKW[Nle]W TCDSKRACCEGLRCKLWCRK DI{Amide} |
| 724 | Pra-[Nle6;Glu26,28]JzTx-V(1-29) | {H}-[Pra]YCQKW[Nle]W TCDSKRACCEGLRCKLWCEK EI{Amide} |
| 725 | Pra-[Nle6;Glu27,28]JzTx-V(1-29) | {H}-[Pra]YCQKW[Nle]W TCDSKRACCEGLRCKLWCRE EI{Amide} |
| 726 | Pra-[Nle6;Glu28]JzTx-V(1-29)-Glu | {H}-[Pra]YCQKW[Nle]W TCDSKRACCEGLRCKLWCRK EIE{Amide} |
| 727 | Pra-[Nle6;Ala20;Glu28]JzTx-V(1-29) | {H}-[Pra]YCQKW[Nle]W TCDSKRACCEGLACKLWCRK EI{Amide} |
| 728 | Pra-[Nle6;Glu12,28;Lys17]JzTx-V(1-29) | {H}-[Pra]YCQKW[Nle]W TCDSERACCKGLRCKLWCRK EI{Amide} |
| 729 | Pra-[Nle6;Glu12;Lys17]JzTx-V(1-29) | {H}-[Pra]YCQKW[Nle]W TCDSERACCKGLRCKLWCRK II{Amide} |
| 730 | Pra-[Nle6;Glu12]JzTx-V(1-29) | {H}-[Pra]YCQKW[Nle]W TCDSERACCEGLRCKLWCRK II{Amide} |

TABLE 5-continued

Amino acid sequences of JzTx-V and JzTx-V peptide analogs.

| SEQ ID NO. | Designation | Amino Acid Sequence |
|---|---|---|
| 731 | [Nle6;Glu28]JzTx-V(2-29) | {H}-CQKW[Nle]WTCDSK(ivDde)RACCEGLRCKLWCRKEI{Amide} |
| 732 | CyA-[Nle6;Glu12,28;Pra17]JzTx-V(1-29) | {H}-[CyA]YCQKW[Nle]WTCDSERACC[Pra]GLRCKLWCRKEI{Amide} |
| 733 | CyA-[Nle6;Glu14,28;Pra17]JzTx-V(1-29) | {H}-[CyA]YCQKW[Nle]WTCDSKRECC[Pra]GLRCKLWCRKEI{Amide} |
| 734 | Glu-Pra-[Nle6;Glu11,28]JzTx-V(1-29) | {H}-E[Pra]YCQKW[Nle]WTCDEKRACCEGLRCKLWCRKEI{Amide} |
| 735 | Glu-Pra-[Nle6;Glu12,28]JzTx-V(1-29) | {H}-E[Pra]YCQKW[Nle]WTCDSERACCEGLRCKLWCRKEI{Amide} |
| 736 | Glu-[Pra1;Nle6;Glu11,28]JzTx-V(1-29) | {H}-E[Pra]CQKW[Nle]WTCDEKRACCEGLRCKLWCRKEI{Amide} |
| 737 | Glu-[Pra1;Nle6;Glu12,28]JzTx-V(1-29) | {H}-E[Pra]CQKW[Nle]WTCDSERACCEGLRCKLWCRKEI{Amide} |
| 738 | Glu-[Pra1;Nle6;Glu14,28]JzTx-V(1-29) | {H}-E[Pra]CQKW[Nle]WTCDSKRECCEGLRCKLWCRKEI{Amide} |
| 739 | Pra-[Glu1,11,28;Nle6]JzTx-V(1-29) | {H}-[Pra]ECQKW[Nle]WTCDEKRACCEGLRCKLWCRKEI{Amide} |
| 740 | Glu-Pra-[Nle6;Glu14,28]JzTx-V(1-29) | {H}-E[Pra]YCQKW[Nle]WTCDSKRECCEGLRCKLWCRKEI{Amide} |
| 741 | Glu-Pra-[Glu1,11,28;Nle6]JzTx-V(1-29) | {H}-E[Pra]ECQKW[Nle]WTCDEKRACCEGLRCKLWCRKEI{Amide} |
| 742 | Pra-[Glu1,12,28;Nle6]JzTx-V(1-29) | {H}-[Pra]ECQKW[Nle]WTCDSERACCEGLRCKLWCRKEI{Amide} |
| 743 | Pra-[Glu1,14,28;Nle6]JzTx-V(1-29) | {H}-[Pra]ECQKW[Nle]WTCDSKRECCEGLRCKLWCRKEI{Amide} |
| 744 | Pra-[Nle6;Glu11,12,28]JzTx-V(1-29) | {H}-[Pra]YCQKW[Nle]WTCDEERACCEGLRCKLWCRKEI{Amide} |
| 745 | Pra-[Nle6;Glu11,14,28]JzTx-V(1-29) | {H}-[Pra]YCQKW[Nle]WTCDEKRECCEGLRCKLWCRKEI{Amide} |
| 746 | Glu-Pra-[Glu1,12,28;Nle6]JzTx-V(1-29) | {H}-E[Pra]ECQKW[Nle]WTCDSERACCEGLRCKLWCRKEI{Amide} |
| 747 | Pra-[Nle6;Glu12,14,28]JzTx-V(1-29) | {H}-[Pra]YCQKW[Nle]WTCDSERECCEGLRCKLWCRKEI{Amide} |
| 748 | Glu-[Pra1;Nle6;Glu11,12,28]JzTx-V(1-29) | {H}-E[Pra]CQKW[Nle]WTCDEERACCEGLRCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 749 | Glu-[Pra1;Nle6;Glu12,14,28]JzTx-V(1-29) | {H}-E[Pra]CQKW[Nle]W TCDSERECCEGLRCKLWCRK EI{Amide} |
| 750 | Glu-[Pra1;Nle6;Glu11,14,28]JzTx-V(1-29) | {H}-E[Pra]CQKW[Nle]W TCDEKRECCEGLRCKLWCRK EI{Amide} |
| 751 | Pra-[Glu1,11,14,28;Nle6]JzTx-V(1-29) | {H}-[Pra]ECQKW[Nle]W TCDEKRECCEGLRCKLWCRK EI{Amide} |
| 752 | Glu-Pra-[Glu1,14,28;Nle6]JzTx-V(1-29) | {H}-E[Pra]ECQKW[Nle] WTCDSKRECCEGLRCKLWCR KEI{Amide} |
| 753 | Pra-[Glu1,12,14,28;Nle6]JzTx-V(1-29) | {H}-[Pra]ECQKW[Nle]W TCDSERECCEGLRCKLWCRK EI{Amide} |
| 754 | Pra-[Glu1,11,12,28;Nle6]JzTx-V(1-29) | {H}-[Pra]ECQKW[Nle]W TCDEERACCEGLRCKLWCRK EI{Amide} |
| 755 | Pra-[Nle6;Glu11,12,14,28]JzTx-V(1-29) | {H}-[Pra]YCQKW[Nle]W TCDEERECCEGLRCKLWCRK EI{Amide} |
| 756 | CyA-[Glu1,12,14,28;Nle6;Pra17] JzTx-V(1-29) | {H}-[CyA]ECQKW[Nle]W TCDSERECC[Pra]GLRCKL WCRKEI{Amide} |
| 757 | CyA-[Glu1,11,12,14,28;Nle6;Pra17] JzTx-V(1-29) | {H}-[CyA]ECQKW[Nle]W TCDEERECC[Pra]GLRCKL WCRKEI{Amide} |
| 758 | CyA-[Nle6;Pra17]JzTx-V(1-29) | {H}-[CyA]YCQKW[Nle]W TCDSKRACC[Pra]GLRCKL WCRKII{Amide} |
| 759 | CyA-[Nle6;Glu12;Pra17]JzTx-V(1-29) | {H}-[CyA]YCQKW[Nle]W TCDSERACC[Pra]GLRCKL WCRKII{Amide} |
| 760 | CyA-[Nle6;Glu14;Pra17]JzTx-V(1-29) | {H}-[CyA]YCQKW[Nle]W TCDSKRECC[Pra]GLRCKL WCRKII{Amide} |
| 761 | CyA-[Nle6;Pra17;Glu27]JzTx-V(1-29) | {H}-[CyA]YCQKW[Nle]W TCDSKRACC[Pra]GLRCKL WCREII{Amide} |
| 762 | Nva-[Nle6;Glu12,14;Pra17]JzTx-V(1-29) | {H}-[Nva]YCQKW[Nle]W TCDSERECC[Pra]GLRCKL WCRKII{Amide} |
| 763 | CyA-[Nle6;Glu12,27;Pra17]JzTx-V(1-29) | {H}-[CyA]YCQKW[Nle]W TCDSERACC[Pra]GLRCKL WCREII{Amide} |
| 764 | CyA-[Nle6;Pra17;Glu27,28]JzTx-V(1-29) | {H}-[CyA]YCQKW[Nle]W TCDSKRACC[Pra]GLRCKL WCREEI{Amide} |
| 765 | CyA-[Nle6;Glu11,28;Pra17]JzTx-V(1-29) | {H}-[CyA]YCQKW[Nle]W TCDEKRACC[Pra]GLRCKL WCRKEI{Amide} |
| 766 | Glu-[CyA1;Nle6;Glu11,28;Pra17PzTx-V(1-29) | {H}-E[CyA]CQKW[Nle]W TCDEKRACC[Pra]GLRCKL WCRKEI{Amide} |

TABLE 5-continued

Amino acid sequences of JzTx-V and JzTx-V peptide analogs.

| SEQ ID NO. | Designation | Amino Acid Sequence |
|---|---|---|
| 767 | Glu-[Nle6;Glu11,28;Pra17]JzTx-V(1-29) | {H}-EYCQKW[Nle]WTCDE KRACC[Pra]GLRCKLWCRK EI{Amide} |
| 768 | CyA-[Glu1,11,28;Nle6;Pra17]JzTx-V(1-29) | {H}-[CyA]ECQKW[Nle]W TCDEKRACC[Pra]GLRCKL WCRKEI{Amide} |
| 769 | Glu-Nva-[Nle6;Glu11,28;Pra17] JzTx-V(1-29) | {H}-E[Nva]YCQKW[Nle] WTCDEKRACC[Pra]GLRCK LWCRKEI{Amide} |
| 770 | Nva-[Glu1,14,28;Nle6;Pra17]JzTx-V(1-29) | {H}-[Nva]ECQKW[Nle]W TCDSKRECC[Pra]GLRCKL WCRKEI{Amide} |
| 771 | CyA-[Glu1,14,28;Nle6;Pra17]JzTx-V(1-29) | {H}-[CyA]ECQKW[Nle]W TCDSKRECC[Pra]GLRCKL WCRKEI{Amide} |
| 772 | Glu-Nva-[Glu1,11,28;Nle6;Pra17] JzTx-V(1-29) | {H}-E[Nva]ECQKW[Nle] WTCDEKRACC[Pra]GLRCK LWCRKEI{Amide} |
| 773 | Glu-[Nva1;Nle6;Glu14,28;Pra17] JzTx-V(1-29) | {H}-E[Nva]CQKW[Nle]W TCDSKRECC[Pra]GLRCKL WCRKEI{Amide} |
| 774 | Glu-[Nva1;Nle6;Glu11,28;Pra17] JzTx-V(1-29) | {H}-E[Nva]CQKW[Nle]W TCDEKRACC[Pra]GLRCKL WCRKEI{Amide} |
| 775 | Pra-[Nle6;Cit13;Glu28]JzTx-V(1-29) | {H}-[Pra]YCQKW[Nle]W TCDSK[Cit]ACCEGLRCKL WCRKEI{Amide} |
| 776 | Pra-[BhGln4;Nle6;Glu28]JzTx-V(1-29) | {H}-[Pra]YCQ[BhGln]W [Nle]WTCDSKRACCEGLRC KLWCRKEI{Amide} |
| 777 | Pra-[Nle6;BhGln12;Glu28]JzTx-V(1-29) | {H}-[Pra]YCQKW[Nle]W TCDS[BhGln]RACCEGLRC KLWCRKEI{Amide} |
| 778 | Pra-[Nle6;BhGln13;Glu28]JzTx-V(1-29) | {H}-[Pra]YCQKW[Nle]W TCDSK[BhGln]ACCEGLRC KLWCRKEI{Amide} |
| 779 | Pra-[Nle6;BhGln20;Glu28]JzTx-V(1-29) | {H}-[Pra]YCQKW[Nle]W TCDSKRACCEGL[BhGln]C KLWCRKEI{Amide} |
| 780 | Pra-[Nle6;BhGln22;Glu28]JzTx-V(1-29) | {H}-[Pra]YCQKW[Nle]W TCDSKRACCEGLRC [BhGln]LWCRKEI {Amide} |
| 781 | Pra-[Nle6;BhGln26;Glu28]JzTx-V(1-29) | {H}-[Pra]YCQKW[Nle]W TCDSKRACCEGLRCKLWC [BhGln]KEI{Amide} |
| 782 | Pra-[Nle6;BhGln27;Glu28]JzTx-V(1-29) | {H}-[Pra]YCQKW[Nle]W TCDSKRACCEGLRCKLWCR [BhGln]EI{Amide} |
| 783 | Pra-[BhGln4;Nle6;Cit13;Glu28] JzTx-V(1-29) | {H}-[Pra]YCQ[BhGln]W [Nle]WTCDSK[Cit]ACCE GLRCKLWCRKEI{Amide} |
| 784 | Pra-[BhGln4;Nle6;Cit20;Glu28] JzTx-V(1-29) | {H}-[Pra]YCQ[BhGln]W [Nle]WTCDSKRACCEGL [Cit]CKLWCRKEI {Amide} |

TABLE 5-continued

Amino acid sequences of JzTx-V and JzTx-V peptide analogs.

| SEQ ID NO. | Designation | Amino Acid Sequence |
|---|---|---|
| 785 | Pra-[BhGln4;Nle6;Cit26;Glu28] JzTx-V(1-29) | {H}-[Pra]YCQ[BhGln]W [Nle]WTCDSKRACCEGLRC KLWC[Cit]KEI{Amide} |
| 786 | Pra-[Nle6;BhGln12;Cit13;Glu28] JzTx-V(1-29) | {H}-[Pra]YCQKW[Nle]W TCDS[BhGln][Cit]ACCE GLRCKLWCRKEI{Amide} |
| 787 | Pra-[Nle6;BhGln12;Cit20;Glu28] JzTx-V(1-29) | {H}-[Pra]YCQKW[Nle]W TCDS[BhGln]RACCEGL [Cit]CKLWCRKEI {Amide} |
| 788 | Pra-[Nle6;BhGln12;Cit26;Glu28] JzTx-V(1-29) | {H}-[Pra]YCQKW[Nle]W TCDS[BhGln]RACCEGLRC KLWC[Cit]KEI{Amide} |
| 789 | Pra-[Nle6;Cit13;BhGln22;Glu28] JzTx-V(1-29) | {H}-[Pra]YCQKW[Nle]W TCDSK[Cit]ACCEGLRC [BhGln]LWCRKEI {Amide} |
| 790 | Pra-[Nle6;Cit20;BhGln22;Glu28] JzTx-V(1-29) | {H}-[Pra]YCQKW[Nle]W TCDSKRACCEGL[Cit]C [BhGln]LWCRKEI {Amide} |
| 791 | Pra-[Nle6;BhGln22;Cit26;Glu28] JzTx-V(1-29) | {H}-[Pra]YCQKW[Nle]W TCDSKRACCEGLRC [BhGln]LWC[Cit]KEI {Amide} |
| 792 | Pra-[Nle6;Cit13;BhGln27;Glu28] JzTx-V(1-29) | {H}-[Pra]YCQKW[Nle]W TCDSK[Cit]ACCEGLRCKL WCR[BhGln]EI{Amide} |
| 793 | Pra-[Nle6;Cit20;BhGln27;Glu28] JzTx-V(1-29) | {H}-[Pra]YCQKW[Nle]W TCDSKRACCEGL[Cit]CKL WCR[BhGln]EI{Amide} |
| 794 | Pra-[Nle6;Cit26;BhGln27;Glu28] JzTx-V(1-29) | {H}-[Pra]YCQKW[Nle]W TCDSKRACCEGLRCKLWC [Cit][BhGln]EI {Amide} |
| 795 | Pra-[Nle6;Cit20;Glu28]JzTx-V(1-29) | {H}-[Pra]YCQKW[Nle]W TCDSKRACCEGL[Cit]CKL WCRKEI{Amide} |
| 796 | Pra-[Nle6;Cit26;Glu28]JzTx-V(1-29) | {H}-[Pra]YCQKW[Nle]W TCDSKRACCEGLRCKLWC [Cit]KEI{Amide} |
| 797 | Pra-[Nle6;Cit13,20;Glu28]JzTx-V(1-29) | {H}-[Pra]YCQKW[Nle]W TCDSK[Cit]ACCEGL [Cit]CKLWCRKEI {Amide} |
| 798 | Pra-[Nle6;Cit13,26;Glu28]JzTx-V(1-29) | {H}-[Pra]YCQKW[Nle]W TCDSK[Cit]ACCEGLRCKL WC[Cit]KEI{Amide} |
| 799 | Pra-[Nle6;Cit20,26;Glu28]JzTx-V(1-29) | {H}-[Pra]YCQKW[Nle]W TCDSKRACCEGL[Cit]CKL WC[Cit]KEI{Amide} |
| 800 | Pra-[Nle6;Cit13,20,26;Glu28] JzTx-V(1-29) | {H}-[Pra]YCQKW[Nle]W TCDSK[Cit]ACCEGL [Cit]CKLWC[Cit]KEI {Amide} |

TABLE 5-continued

Amino acid sequences of JzTx-V and JzTx-V peptide analogs.

| SEQ ID NO. | Designation | Amino Acid Sequence |
|---|---|---|
| 801 | Pra-[Gln4;Nle6;Glu28]JzTx-V(1-29) | {H}-[Pra]YCQQW[Nle]W TCDSKRACCEGLRCKLWCRK EI{Amide} |
| 802 | Pra-[Nle6;Gln12;Glu28]JzTx-V(1-29) | {H}-[Pra]YCQKW[Nle]W TCDSQRACCEGLRCKLWCRK EI{Amide} |
| 803 | Pra-[Nle6;Gln13;Glu28]JzTx-V(1-29) | {H}-[Pra]YCQKW[Nle]W TCDSKQACCEGLRCKLWCRK EI{Amide} |
| 804 | Pra-[Nle6;Gln22;Glu28]JzTx-V(1-29) | {H}-[Pra]YCQKW[Nle]W TCDSKRACCEGLRCQLWCRK EI{Amide} |
| 805 | Pra-[Nle6;Gln26;Glu28]JzTx-V(1-29) | {H}-[Pra]YCQKW[Nle]W TCDSKRACCEGLRCKLWCQK EI{Amide} |
| 806 | Pra-[Nle6;Gln27;Glu28]JzTx-V(1-29) | {H}-[Pra]YCQKW[Nle]W TCDSKRACCEGLRCKLWCRQ EI{Amide} |
| 807 | Pra-[Gln4;Nle6;Cit13;Glu28]JzTx-V(1-29) | {H}-[Pra]YCQQW[Nle]W TCDSK[Cit]ACCEGLRCKL WCRKEI{Amide} |
| 808 | Pra-[Gln4;Nle6;Cit20;Glu28]JzTx-V(1-29) | {H}-[Pra]YCQQW[Nle]W TCDSKRACCEGL[Cit]CKL WCRKEI{Amide} |
| 809 | Pra-[Gln4;Nle6;Cit26;Glu28]JzTx-V(1-29) | {H}-[Pra]YCQQW[Nle]W TCDSKRACCEGLRCKLWC [Cit]KEI{Amide} |
| 810 | Pra-[Nle6;Gln12;Cit13;Glu28]JzTx-V(1-29) | {H}-[Pra]YCQKW[Nle]W TCDSQ[Cit]ACCEGLRCKL WCRKEI{Amide} |
| 811 | Pra-[Nle6;Gln12;Cit20;Glu28]JzTx-V(1-29) | {H}-[Pra]YCQKW[Nle]W TCDSQRACCEGL[Cit]CKL WCRKEI{Amide} |
| 812 | Pra-[Nle6;Cit20;Gln27;Glu28]JzTx-V(1-29) | {H}-[Pra]YCQKW[Nle]W TCDSKRACCEGL[Cit]CKL WCRQEI{Amide} |
| 813 | Pra-[Nle6;Cit26;Gln27;Glu28]JzTx-V(1-29) | {H}-[Pra]YCQKW[Nle]W TCDSKRACCEGLRCKLWC [Cit]QEI{Amide} |
| 814 | Pra-[Nle6;Gln12;Cit26;Glu28]JzTx-V(1-29) | {H}-[Pra]YCQKW[Nle]W TCDSQRACCEGLRCKLWC [Cit]KEI{Amide} |
| 815 | Pra-[Nle6;Cit13;Gln27;Glu28]JzTx-V(1-29) | {H}-[Pra]YCQKW[Nle]W TCDSK[Cit]ACCEGLRCKL WCRQEI{Amide} |
| 816 | Pra-[Nle6;Cit13;Gln22;Glu28]JzTx-V(1-29) | {H}-[Pra]YCQKW[Nle]W TCDSK[Cit]ACCEGLRCQL WCRKEI{Amide} |
| 817 | Pra-[Nle6;Cit20;Gln22;Glu28]JzTx-V(1-29) | {H}-[Pra]YCQKW[Nle]W TCDSKRACCEGL[Cit]CQL WCRKEI{Amide} |
| 818 | Pra-[Nle6;Gln22;Cit26;Glu28]JzTx-V(1-29) | {H}-[Pra]YCQKW[Nle]W TCDSKRACCEGLRCQLWC [Cit]KEI{Amide} |

TABLE 5-continued

Amino acid sequences of JzTx-V and JzTx-V peptide analogs.

| SEQ ID NO. | Designation | Amino Acid Sequence |
|---|---|---|
| 819 | CyA-[Nle6;Ala12;Pra17;Glu28]JzTx-V(1-29) | {H}-[CyA]YCQKW[Nle]WTCDSARACC[Pra]GLRCKLWCRKEI{Amide} |
| 820 | CyA-[Nle6;Pra17;Asp18;Glu28]JzTx-V(1-29) | {H}-[CyA]YCQKW[Nle]WTCDSKRACC[Pra]DLRCKLWCRKEI{Amide} |
| 821 | CyA-[Nle6;Pra17;Val20;Glu28]JzTx-V(1-29) | {H}-[CyA]YCQKW[Nle]WTCDSKRACC[Pra]GLVCKLWCRKEI{Amide} |
| 822 | CyA-[Nle6;Pra17;Gln22;Glu28]JzTx-V(1-29) | {H}-[CyA]YCQKW[Nle]WTCDSKRACC[Pra]GLRCQLWCRKEI{Amide} |
| 823 | CyA-[Nle6;Pra17;Tyr27;Glu28]JzTx-V(1-29) | {H}-[CyA]YCQKW[Nle]WTCDSKRACC[Pra]GLRCKLWCRYEI{Amide} |
| 824 | CyA-[Nle6;Pra17;Leu27;Glu28]JzTx-V(1-29) | {H}-[CyA]YCQKW[Nle]WTCDSKRACC[Pra]GLRCKLWCRLEI{Amide} |
| 825 | Pra-[Nle6]JzTx45(1-29) | {H}-[Pra]YCQKW[Nle]WTCDSERKCCEGYVCELWCKYNL{Amide} |
| 826 | [Nle6,Pra17]JzTx45(1-29) | {H}-YCQKW[Nle]WTCDSERKCC[Pra]GYVCELWCKYNL{Amide} |
| 827 | Pra-[Nle6]JzTx-V(1-29)-FreeAcid | {H}-[Pra]YCQKW[Nle]WTCDSKRACCEGLRCKLWCRKII{FreeAcid} |
| 828 | Pra-[Nle6;Glu28]JzTx-V(1-29)-Gly-FreeAcid | {H}-[Pra]YCQKW[Nle]WTCDSKRACCEGLRCKLWCRKEIG{FreeAcid} |
| 829 | Pra[Nle6;Glu28]JzTx-V(1-29)-FreeAcid | {H}-[Pra]YCQKW[Nle]WTCDSKRACCEGLRCKLWCRKEI{FreeAcid} |
| 830 | CyA-[Nle6;Pra17;Lys26,28;Leu29]JzTx-V(1-29)-Trp-FreeAcid | {H}-[CyA]YCQKW[Nle]WTCDSKRACC[Pra]GLRCKLWCKKKLW{FreeAcid} |
| 831 | CyA-[Nle6;Pra17;Glu28]JzTx-V(1-29)-Glu-Glu-Gly-FreeAcid | {H}-[CyA]YCQKW[Nle]WTCDSKRACC[Pra]GLRCKLWCRKEIEEG{FreeAcid} |
| 832 | CyA-[Nle6;Pra17;Lys28]JzTx-V(1-29)-Glu-Glu-Gly-FreeAcid | {H}-[CyA]YCQKW[Nle]WTCDSKRACC[Pra]GLRCKLWCRKKIEEG{FreeAcid} |
| 833 | CyA-[Nle6;Pra17;Glu28]JzTx-V(1-29)-Glu-Trp-FreeAcid | {H}-[CyA]YCQKW[Nle]WTCDSKRACC[Pra]GLRCKLWCRKEIEW{FreeAcid} |
| 834 | CyA-[Nle6;Pra17;Lys28]JzTx-V(1-29)-Glu-Trp-FreeAcid | {H}-[CyA]YCQKW[Nle]WTCDSKRACC[Pra]GLRCKLWCRKKIEW{FreeAcid} |
| 835 | Pra-[SeC2,16;Nle6;Glu12,28]JzTx-V(1-29) | {H}-[Pra]Y[SeC]QKW[Nle]WTCDSERAC[SeC]EGLRCKLWCRKEI{Amide} |
| 836 | Pra-[Nle6;SeC9,21;Glu12,28]JzTx-V(1-29) | {H}-[Pra]YCQKW[Nle]WT[SeC]DSERACCEGLR[SeC]KLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 837 | Pra-[Nle6;Glu12,28;SeC15,25]JzTx-V(1-29) | {H}-[Pra]YCQKW[Nle]W TCDSERA[SeC]CEGLRCKL W[SeC]RKEI{Amide} |
| 838 | Pra-[SeC2,16;Nle6;Glu28]JzTx-V(1-29) | {H}-[Pra]Y[SeC]QKW [Nle]WTCDSKRAC[SeC]E GLRCKLWCRKEI{Amide} |
| 839 | Pra-[Nle6;SeC9,21;Glu28]JzTx-V(1-29) | {H}-[Pra]YCQKW[Nle]W T[SeC]DSKRACCEGLR [SeC]KLWCRKEI{Amide} |
| 840 | Pra-[Nle6;SeC15,25;Glu28]JzTx-V(1-29) | {H}-[Pra]YCQKW[Nle]W TCDSKRA[SeC]CEGLRCKL W[SeC]RKEI{Amide} |
| 841 | Pra-[1-Nal5;Nle6;Glu28]JzTx-V(1-29) | {H}-[Pra]YCQK[1-Nal] [Nle]WTCD SKRACCEGLR CKLWCRKEI{Amide} |
| 842 | Pra-[2-Nal5;Nle6;Glu28]JzTx-V(1-29) | {H}-[Pra]YCQK[2-Nal] [Nle]WTCD SKRACCEGLR CKLWCRKEI{Amide} |
| 843 | Pra-[Phe5;Nle6;Glu28]JzTx-V(1-29) | {H}-[Pra]YCQKF[Nle]W TCDSKRACCEGLRCKLWCRK EI{Amide} |
| 844 | Pra-[hPhe5;Nle6;Glu28]JzTx-V(1-29) | {H}-[Pra]YCQK[hPhe] [Nle]WTCDSKRACCEGLRC KLWCRKEI{Amide} |
| 845 | Pra-[5-BrW5;Nle6;Glu28]JzTx-V(1-29) | {H}-[Pra]YCQK[5-BrW] [Nle]WTCDSKRACCEGLRC KLWCRKEI{Amide} |
| 846 | Pra-[Nle6;1-Nal7;Glu28]JzTx-V(1-29) | {H}-[Pra]YCQKW[Nle] [1-Nal]TCDSKRACCEGLR CKLWCRKEI{Amide} |
| 847 | Pra-[Nle6;2-Nal7;Glu28]JzTx-V(1-29) | {H}-[Pra]YCQKW[Nle] [2-Nal]TCDSKRACCEGLR CKLWCRKEI{Amide} |
| 848 | Pra-[Nle6;Phe7;Glu28]JzTx-V(1-29) | {H}-[Pra]YCQKW[Nle]F TCDSKRACCEGLRCKLWCRK EI{Amide} |
| 849 | Pra-[Nle6;hPhe7;Glu28]JzTx-V(1-29) | {H}-[Pra]YCQKW[Nle] [hPhe]TCDSKRACCEGLRC KLWCRKEI{Amide} |
| 850 | Pra-[Nle6;5-BrW7;Glu28]JzTx-V(1-29) | {H}-[Pra]YCQKW[Nle] [5-BrW]TCDSKRACCEGLR CKLWCRKEI{Amide} |
| 851 | Pra-[Nle6;1-Nal24;Glu28]JzTx-V(1-29) | {H}-[Pra]YCQKW[Nle]W TCDSKRACCEGLRCKL [1-Nal]CRKEI{Amide} |
| 852 | Pra-[Nle6;2-Nal24;Glu28]JzTx-V(1-29) | {H}-[Pra]YCQKW[Nle]W TCDSKRACCEGLRCKL [2-Nal]CRKEI{Amide} |
| 853 | Pra-[Nle6;Phe24;Glu28]JzTx-V(1-29) | {H}-[Pra]YCQKW[Nle]W TCDSKRACCEGLRCKLFCRK EI{Amide} |
| 854 | Pra-[Nle6;hPhe24;Glu28]JzTx-V(1-29) | {H}-[Pra]YCQKW[Nle]W TCDSKRACCEGLRCKL [hPhe]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 855 | Pra-[Nle6;Ile23;Glu28]JzTx-V(1-29) | {H}-[Pra]YCQKW[Nle]W TCDSKRACCEGLRCKIWCRK EI{Amide} |
| 856 | Pra-[Nle6,23;Glu28]JzTx-V(1-29) | {H}-[Pra]YCQKW[Nle]W TCDSKRACCEGLRCK[Nle] WCRKEI{Amide} |
| 857 | Pra-[Nle6;Nva23;Glu28]JzTx-V(1-29) | {H}-[Pra]YCQKW[Nle]W TCDSKRACCEGLRCK[Nva] WCRKEI{Amide} |
| 858 | Pra-[Nle6;5-BrW24;Glu28]JzTx-V(1-29) | {H}-[Pra]YCQKW[Nle]W TCDSKRACCEGLRCKL [5-BrW]CRKEI{Amide} |
| 859 | Pra-[Nle6;Chg23;Glu28]JzTx-V(1-29) | {H}-[Pra]YCQKW[Nle]W TCDSKRACCEGLRCK[Chg] WCRKEI{Amide} |
| 860 | Pra-[Nle6;Cha23;Glu28]JzTx-V(1-29) | {H}-[Pra]YCQKW[Nle]W TCDSKRACCEGLRCK[Cha] WCRKEI{Amide} |
| 861 | Pra-[Nle6;Glu28;Phe29]JzTx-V(1-29) | {H}-[Pra]YCQKW[Nle]W TCDSKRACCEGLRCKLWCRK EF{Amide} |
| 862 | Pra-[Nle6;Glu28;Cha29]JzTx-V(1-29) | {H}-[Pra]YCQKW[Nle]W TCDSKRACCEGLRCKLWCRK E[Cha]{Amide} |
| 863 | Pra-[Phe6;Glu28]JzTx-V(1-29) | {H}-[Pra]YCQKWFWTCDS KRACCEGLRCKLWCRKEI {Amide} |
| 864 | CyA-[hPhe5;Nle6;Pra17;Glu28]JzTx-V(1-29) | {H}-[CyA]YCQK[Nle]WT CDSKRACC[Pra[GLRCKLW CRKEI{Amide} |
| 865 | CyA-[Nle6;Pra17;Glu28;Cha29]JzTx-V(1-29) | {H}-[CyA]YCQKW[Nle]W TCDSKRACC[Pra]GLRCKL WCRKE[Cha]{Amide} |
| 866 | CyA-[Glu1,28;Nle6;Pra17;Cha29] JzTx-V(1-29) | {H}-[CyA]ECQKW[Nle]W TCDSKRACC[Pra]GLRCKL WCRKE[Cha]{Amide} |
| 867 | Glu-[hPhe5;Nle6;Pra17;Glu28;Cha29] JzTx-V(1-29) | {H}-EYCQK[hPhe][Nle] WTCDSKRACC[Pra]GLRCK LWCRKE[Cha]{Amide} |
| 868 | Glu-Nva-[Nle6;Pra17;Glu28;Cha29] JzTx-V(1-29) | {H}-E[Nva]YCQKW[Nle] WTCDSKRACC[Pra]GLRCK LWCRKE[Cha]{Amide} |
| 869 | CyA-[Glu1,11,28;Nle6;Pra17;Cha29] JzTx-V(1-29) | {H}-[CyA]ECQKW[Nle]W TCDEKRACC[Pra]GLRCKL WCRKE[Cha]{Amide} |
| 870 | CyA-[Nle6;Pra17;5-BrW24;Glu28] JzTx-V(1-29) | {H}-[CyA]YCQKW[Nle]W TCDSKRACC[Pra]GLRCKL [5-BrW]CRKEI{Amide} |
| 871 | Pra-[Nle6;5-BrW24]JzTx-V(1-29) | {H}-[Pra]YCQKW[Nle]W TCDSKRACCEGLRCKL [5-BrW]CRKII{Amide} |
| 872 | CyA-[Nle6;Pra17;5-BrW24]JzTx-V(1-29) | {H}-[CyA]YCQKW[Nle]W TCDSKRACC[Pra]GLRCKL [5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 873 | CyA-[Nle6;Pra17;6-BrW24;Glu28] JzTx-V(1-29) | {H}-[CyA]YCQKW[Nle]W TCDSKRACC[Pra]GLRCKL [6-BrW]CRKEI{Amide} |
| 874 | CyA-[Nle6;Pra17;6-MeW24;Glu28] JzTx-V(1-29) | {H}-[CyA]YCQKW[Nle]W TCDSKRACC[Pra]GLRCKL [6-MeW]CRKEI{Amide} |
| 875 | CyA-[Nle6;Pra17;7-BrW24;Glu28] JzTx-V(1-29) | {H}-[CyA]YCQKW[Nle]W TCDSKRACC[Pra]GLRCKL [7-BrW]CRKEI{Amide} |
| 876 | CyA-[Nle6;Pra17;Glu28;Phe29] JzTx-V(1-29) | {H}-[CyA]YCQKW[Nle]W TCDSKRACC[Pra]GLRCKL WCRKEF{Amide} |
| 877 | CyA-[Nle6;Pra17;Glu28;hPhe29] JzTx-V(1-29) | {H}-[CyA]YCQKW[Nle]W TCDSKRACC[Pra]GLRCKL WCRKE{Amide} |
| 878 | Pra-[hPhe5;Nle6;Glu28;Cha29] JzTx-V(1-29) | {H}-[Pra]YCQK[Nle]WT CDSKRACCEGLRCKLWCRKE [Cha]{Amide} |
| 879 | [Nle6;Pra12;Glu28]JzTx-V(1-29) | {H}-YCQKW[Nle]WTCDS [Pra]RACCEGLRCKLWCRK EI{Amide} |
| 880 | CyA-Nle6,Lys(Pra-NPEG3)14,Glu28] JzTx-V(1-29) | {H}-[CyA]YCQKW[Nle]W TCDSKR[KPPG3]CCEGLRC KLWCRKEI{Amide} |
| 881 | CyA-[Leu6,Lys(Pra-NPEG3)14,Glu28] JzTx-V(1-29) | {H}-[CyA]YCQKWLWTCDS KR[KPPG3]CCEGLRCKLWC RKEI{Amide} |
| 882 | Pra-[Nle6;Lys(AOA)12;Glu28]JzTx-V(1-29) | {H}-[Pra]YCQKW[Nle]W TCDSK(AOA)RACCEGLRCK LWCRKEI{Amide} |
| 883 | Atz(NPEG10)-[Nle6;Glu28]JzTx-V(1-29) | {H}-[Atz](NPeg9)YCQK W[Nle]WTCDSKRACCEGLR CKLWCRKEI{Amide} |
| 884 | Atz(PEG11-bromoacetamide)-[Nle6,Glu28] JzTx-V(1-29) | {H}-[Atz](PEG11-bromoacetamide)YCQKW [Nle]WTCDSKRACCEGLRC KLWCRKEI{Amide} |
| 885 | Atz-[Nle6,Glu28]JzTx-V(1-29) | {H}-[Atz]YCQKW[Nle]W TCDSKRACCEGLRCKLWCRK EI{Amide} |
| 886 | Atz(NPEG23)-[Nle6]JzTx-V(1-29) | {H}-[N3PGAzNH]YCQKW [Nle]WTCDSKRACCEGLRC KLWCRKII{Amide} |
| 887 | Atz(PEG11-bromoacetamide)-[Nle6] JzTx-V(1-29) | {H}-[Atz](PEG11-bromoacetamide)YCQKW [Nle]WTCDSKRACCEGLRC KLWCRKII{Amide} |
| 888 | CyA-Nle6,Atz(PEG11-bromoacetamide) 17,Glu28]JzTx-V(1-29) | {H}-[CyA]YCQKW[Nle]W TCDSKRACC[Atz](PEG11-bromoacetamide)GLRCK LWCRKEI{Amide) |
| 889 | CyA-[Nle6,Atz17,Glu28]JzTx-V(1-29) | {H}-[CyA]YCQKW[Nle]W TCDSKRACC[Atz]GLRCKL WCRKEI {Amide) |

TABLE 5-continued

Amino acid sequences of JzTx-V and JzTx-V peptide analogs.

| SEQ ID NO. | Designation | Amino Acid Sequence |
|---|---|---|
| 890 | CyA-[Nle6,Lys(Atz(PEG11-bromoacetamide))14,Glu28]JzTx-V(1-29) | {H}-K[CyA]YCQKW[Nle]WTCDSKRK(Atz(PEG11-bromoacetamide))CCEGLRCKLWCRKEI{Amide} |
| 891 | CyA-[Nle6,Lys(Atz(NPEG10))14,Glu28]JzTx-V(1-29) | {H}-K[CyA]YCQKW[Nle]WTCDSKRK(Atz(NPeg9))CCEGLRCKLWCRKEI{Amide} |
| 892 | CyA-[Nle6,Lys(Atz)14,Glu28]JzTx-V(1-29) | {H}-K[CyA]YCQKW[Nle]WTCDSKRK(Atz)CCEGLRCKLWCRKEI{Amide} |
| 893 | Atz-[Nle6;5-BrW24;Glu28]JzTx-V(1-29) | {H}-[Atz]YCQKW[Nle]WTCDSKRACCEGLRCKL[5-BrW]CRKEI{Amide} |
| 894 | CyA-[Nle6;Atz17;5-BrW24;Glu28]JzTx-V(1-29) | {H}-[CyA]YCQKW[Nle]WTCDSKRACC[Atz]GLRCKL[5-BrW]CRKEI{Amide} |
| 895 | CyA-[Nle6,Atz(palmitate)17,Glu28]JzTx-V(1-29) | {H}-[CyA]YCQKW[Nle]WTCDSKRACC[Atz](palmitate)GLRCKLWCRKEI{Amide} |
| 896 | CyA-[Nle6,Atz(GGGGS-SA21-amide)17,Glu28]JzTx-V(1-29) | {H}-[CyA]YCQKW[Nle]WTCDSKRACC[Atz](pentanoyl-GGGGSRLIEDICLPRWGCLWEDD-Amide)GLRCKLWCRKEI{Amide} |
| 897 | CyA-[Nle6,Atz(Histag)17,Glu28]JzTx-V(1-29) | {H}-[CyA]YCQKW[Nle]WTCDSKRACC[Atz](pentanoyl-GGGGSGGGGSSLQKASGALEHHHHHHHH-FreeAcid)GLRCKLWCRKEI{Amide} |
| 898 | Atz(Biotin)-[Nle6]JzTx-V(1-29) | {H}-[Atz](ClickBiotin)YCQKW[Nle]WTCDSKRACCEGLRCKLWCRKII{Amide} |
| 898 | Atz(Biotin)-[Nle6]JzTx-V(1-29) | {H}-[Atz](ClickBiotin)YCQKW[Nle]WTCDSKRACCEGLRCKLWCRKII{Amide} |
| 899 | Atz(palmitate)-[Nle6,Glu28]JzTx-V(1-29) | {H}-[Atz](palmitate)YCQKW[Nle]WTCDSKRACCEGLRCKLWCRKEI{Amide} |
| 900 | CyA-[Atz(palmitate)1,Nle6,Glu28]JzTx-V(1-29) | {H}-[CyA][Atz](palmitate)CQKW[Nle]WTCDSKRACCEGLRCKLWCRKEI{Amide} |
| 901 | CyA-[Nle6,Atz(palmitate)11,Glu28]JzTx-V(1-29) | {H}-[CyA]YCQKW[Nle]WTCD[Atz](palmitate)KRACCEGLRCKLWCRKEI{Amide} |
| 902 | CyA-[Nle6,Atz(palmitate)12,Glu28]JzTx-V(1-29) | {H}-[CyA]YCQKW[Nle]WTCDS[Atz](palmitate)RACCEGLRCKLWCRKEI{Amide} |
| 903 | CyA-[Nle6,Lys(Atz(palmitate))14,Glu28]JzTx-V(1-29) | {H}-[CyA]YCQKW[Nle]WTCDSKRK([Atz](palmitate))CCEGLRCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 904 | Atz(GGGGS-SA21)-[Nle6,Glu28]JzTx-V(1-29) | {H}-[Atz](pentanoyl-GGGGSRLIEDICLPRWGCLWEDD-Amide)YCQKW[Nle]WTCDSKRACCEGLRCKLWCRKEI{Amide} |
| 905 | CyA-[Atz(GGGGS-SA21)1,Nle6,Glu28]JzTx-V(1-29) | {H}-[CyA][Atz](pentanoyl-GGGGSRLIEDICLPRWGCLWEDD-Amide)CQKW[Nle]WTCDSKRACCEGLRCKLWCRKEI{Amide} |
| 906 | CyA-[Nle6,Atz(GGGGS-SA21)11,Glu28]JzTx-V(1-29) | {H}-[CyA]YCQKW[Nle]WTCD[Atz](pentanoyl-GGGGSRLIEDICLPRWGCLWEDD-Amide)KRACCEGLRCKLWCRKEI{Amide} |
| 907 | CyA-[Nle6,Atz(GGGGS-SA21)12,Glu28]JzTx-V(1-29) | {H}-[CyA]YCQKW[Nle]WTCDS[Atz](pentanoyl-GGGGSRLIEDICLPRWGCLWEDD-Amide)RACCEGLRCKLWCRKEI{Amide} |
| 908 | CyA-[Nle6,Lys(Atz(GGGGS-SA21))14,Glu28]JzTx-V(1-29) | {H}-[CyA]YCQKW[Nle]WTCDSKRK([Atz](pentanoyl-GGGGSRLIEDICLPRWGCLWEDD-Amide))CCEGLRCKLWCRKEI{Amide} |
| 909 | CyA-[Nle6;Pra17;Glu28]JzTx-V(1-29)-Trp-FreeAcid | {H}-[CyA]YCQKW[Nle]WTCDSKRACC[Pra]GLRCKLWCRKEIW{FreeAcid} |
| 910 | CyA-[Nle6;Pra17;Leu27,29;Asn28]JzTx-V(1-29)-FreeAcid | {H}-[CyA]YCQKW[Nle]WTCDSKRACC[Pra]GLRCKLWCRLNL{FreeAcid} |
| 911 | Pra-[Nle6;Glu28]JzTx-V(1-29)-Trp-FreeAcid | {H}-[Pra]YCQKW[Nle]WTCDSKRACCEGLRCKLWCRKEIW{FreeAcid} |
| 912 | Pra-[Nle6;Glu28]JzTx-V(1-29)-Glu-Trp-FreeAcid | {H}-[Pra]YCQKW[Nle]WTCDSKRACCEGLRCKLWCRKEIEW{FreeAcid} |
| 913 | Pra-[Nle6;Glu28]JzTx-V(1-29)-Glu-Glu-Gly-FreeAcid | {H}-[Pra]YCQKW[Nle]WTCDSKRACCEGLRCKLWCRKEIEEG{FreeAcid} |
| 914 | Pra-[Nle6;Lys28]JzTx-V(1-29)-Glu-Trp-FreeAcid | {H}-[Pra]YCQKW[Nle]WTCDSKRACCEGLRCKLWCRKKIEW{FreeAcid} |
| 915 | Pra-[Nle6;Lys28]JzTx-V(1-29)-Glu-Glu-Gly-FreeAcid | {H}-[Pra]YCQKW[Nle]WTCDSKRACCEGLRCKLWCRKKIEEG{FreeAcid} |
| 916 | Pra-[Nle6;Leu27,29;Asn28]JzTx-V(1-29)-FreeAcid | {H}-[Pra]YCQKW[Nle]WTCDSKRACCEGLRCKLWCRLNL{FreeAcid} |
| 917 | CyA-[Nle6;Pra17]JzTx-V(1-29)-Trp-FreeAcid | {H}-[CyA]YCQKW[Nle]WTCDSKRACC[Pra]GLRCKLWCRKIIW{FreeAcid} |
| 918 | CyA-[Nle6;Pra17]JzTx-V(1-29)-Glu-Trp-FreeAcid | {H}-[CyA]YCQKW[Nle]WTCDSKRACC[Pra]GLRCKLWCRKIIEW{FreeAcid} |

TABLE 5-continued

Amino acid sequences of JzTx-V and JzTx-V peptide analogs.

| SEQ ID NO. | Designation | Amino Acid Sequence |
|---|---|---|
| 919 | CyA-[Nle6;Pra17]JzTx-V(1-29)-Glu-Glu-Gly-FreeAcid | {H}-[CyA]YCQKW[Nle]WTCDSKRACC[Pra]GLRCKLWCRKIIEEG{FreeAcid} |
| 920 | Pra-[Nle6]JzTx-V(1-29)-Trp-FreeAcid | {H}-[Pra]YCQKW[Nle]WTCDSKRACCEGLRCKLWCRKIIW{FreeAcid} |
| 921 | Pra-[Nle6]JzTx-V(1-29)-Glu-Trp-FreeAcid | {H}-[Pra]YCQKW[Nle]WTCDSKRACCEGLRCKLWCRKIIEW{FreeAcid} |
| 922 | Pra-[Nle6]JzTx-V(1-29)-Glu-Glu-Gly-FreeAcid | {H}-[Pra]YCQKW[Nle]WTCDSKRACCEGLRCKLWCRKIIEEG{FreeAcid} |
| 923 | CyA-[Nle6;Pra17;5-BrW24;Glu28]JzTx-V(1-29)-Trp-FreeAcid | {H}-[CyA]YCQKW[Nle]WTCDSKRACC[Pra]GLRCKL[5-BrW]CRKEIW{FreeAcid} |
| 924 | CyA-[Nle6;Pra17;5-BrW24;Glu28]JzTx-V(1-29)-Glu-Trp-FreeAcid | {H}-[CyA]YCQKW[Nle]WTCDSKRACC[Pra]GLRCKL[5-BrW]CRKEIEW{FreeAcid} |
| 925 | CyA-[Nle6;Pra17;5-BrW24;Glu28]JzTx-V(1-29)-Glu-Glu-Gly-FreeAcid | {H}-[CyA]YCQKW[Nle]WTCDSKRACC[Pra]GLRCKL[5-BrW]CRKEIEEG{FreeAcid} |
| 926 | CyA-[Nle6;Pra17;5-BrW24;Lys28]JzTx-V(1-29)-Glu-Trp-FreeAcid | {H}-[CyA]YCQKW[Nle]WTCDSKRACC[Pra]GLRCKL[5-BrW]CRKKIEW{FreeAcid} |
| 927 | CyA-[Nle6;Pra17;5-BrW24;Lys28]JzTx-V(1-29)-Glu-Glu-Gly-FreeAcid | {H}-[CyA]YCQKW[Nle]WTCDSKRACC[Pra]GLRCKL[5-BrW]CRKKIEEG{FreeAcid} |
| 928 | CyA-[Nle6;Pra17;5-BrW24;Leu27,29;Asn28]JzTx-V(1-29)-FreeAcid | {H}-[CyA]YCQKW[Nle]WTCDSKRACC[Pra]GLRCKL[5-BrW]CRLNL{FreeAcid} |
| 929 | Pra-[Nle6;5-BrW24;Glu28]JzTx-V(1-29)-Trp-FreeAcid | {H}-[Pra]YCQKW[Nle]WTCDSKRACCEGLRCKL[5-BrW]CRKEIW{FreeAcid} |
| 930 | Pra-[Nle6;5-BrW24;Glu28]JzTx-V(1-29)-Glu-Trp-FreeAcid | {H}-[Pra]YCQKW[Nle]WTCDSKRACCEGLRCKL[5-BrW]CRKEIEW{FreeAcid} |
| 931 | Pra-[Nle6;5-BrW24;Glu28]JzTx-V(1-29)-Glu-Glu-Gly-FreeAcid | {H}-[Pra]YCQKW[Nle]WTCDSKRACCEGLRCKL[5-BrW]CRKEIEEG{FreeAcid} |
| 932 | Pra-[Nle6;5-BrW24;Lys28]JzTx-V(1-29)-Glu-Trp-FreeAcid | {H}-[Pra]YCQKW[Nle]WTCDSKRACCEGLRCKL[5-BrW]CRKKIEW{FreeAcid} |
| 933 | Pra-[Nle6;5-BrW24;Lys28]JzTx-V(1-29)-Glu-Glu-Gly-FreeAcid | {H}-[Pra]YCQKW[Nle]WTCDSKRACCEGLRCKL[5-BrW]CRKKIEEG{FreeAcid} |

TABLE 5-continued

Amino acid sequences of JzTx-V and JzTx-V peptide analogs.

| SEQ ID NO. | Designation | Amino Acid Sequence |
|---|---|---|
| 934 | Pra-[Nle6;5-BrW24;Leu27,29;Asn28] JzTx-V(1-29)-FreeAcid | {H}-[Pra]YCQKW[Nle]W TCDSKRACCEGLRCKL [5-BrW]CRLNL {FreeAcid} |
| 935 | CyA-[Nle6;Pra17;5-BrW24]JzTx-V(1-29)-Trp-FreeAcid | {H}-[CyA]YCQKW[Nle]W TCDSKRACC[Pra]GLRCKL [5-BrW]CRKIIW {FreeAcid} |
| 936 | CyA-[Nle6;Pra17;5-BrW24]JzTx-V(1-29)-Glu-Trp-FreeAcid | {H}-[CyA]YCQKW[Nle]W TCDSKRACC[Pra]GLRCKL [5-BrW]CRKIIEW {FreeAcid} |
| 937 | CyA-[Nle6;Pra17;5-BrW24]JzTx-V(1-29)-Glu-Glu-Gly-FreeAcid | {H}-[CyA]YCQKW[Nle]W TCDSKRACC[Pra]GLRCKL [5-BrW]CRKIIEEG {FreeAcid} |
| 938 | Pra-[Nle6;5-BrW24]JzTx-V(1-29)-Trp-FreeAcid | {H}-[Pra]YCQKW[Nle]W TCDSKRACCEGLRCKL [5-BrW]CRKIIW {FreeAcid} |
| 939 | Pra-[Nle6;5-BrW24]JzTx-V(1-29)-Glu-Trp-FreeAcid | {H}-{Pra]YCQKW[Nle]W TCDSKRACCEGLRCKL [5-BrW]CRKIIEW {FreeAcid} |
| 940 | Pra-[Nle6;5-BrW24]JzTx-V(1-29)-Glu-Glu-Gly-FreeAcid | {H}-[Pra]YCQKW[Nle]W TCDSKRACCEGLRCKL [5-BrW]CRKIIEEG {FreeAcid} |
| 941 | CyA-[Glu1,28;Nle6;Ala12;Pra17] JzTx-V(1-29) | {H}-[CyA]ECQKW[Nle]W TCDSARACC[Pra]GLRCKL WCRKEI{Amide} |
| 942 | CyA-[Glu1,28;Nle6;Pra17;Asp18] JzTx-V(1-29) | {H}-[CyA]ECQKW[Nle]W TCDSKRACC[Pra]DLRCKL WCRKEI{Amide} |
| 943 | CyA-[Glu1,28;Nle6;Pra17;Val20] JzTx-V(1-29) | {H}-[CyA]ECQKW[Nle]W TCDSKRACC[Pra]GLVCKL WCRKEI{Amide} |
| 944 | CyA-[Glu1,28;Nle6;Pra17;Gln22] JzTx-V(1-29) | {H}-[CyA]ECQKW[Nle]W TCDSKRACC[Pra]GLRCQL WCRKEI{Amide} |
| 945 | CyA-[Glu1,28;Nle6;Pra17;Tyr27] JzTx-V(1-29) | {H}-[CyA]ECQKW[Nle]W TCDSKRACC[Pra]GLRCKL WCRYEI{Amide} |
| 946 | CyA-[Glu1,28;Nle6;Pra17;Leu27] JzTx-V(1-29) | {H}-[CyA]ECQKW[Nle]W TCDSKRACC[Pra]GLRCKL WCRLEI{Amide} |
| 947 | CyA-[Nle6;Glu11,28;Ala12;Pra17] JzTx-V(1-29) | {H}-[CyA]YCQKW[Nle]W TCDEARACC[Pra]GLRCKL WCRKEI{Amide} |
| 948 | CyA-[Nle6;Glu11,28;Pra17;Asp18] JzTx-V(1-29) | {H}-[CyA]YCQKW[Nle]W TCDEKRACC[Pra]DLRCKL WCRKEI{Amide} |
| 949 | CyA-[Nle6;Glu11,28;Pra17;Val20] JzTx-V(1-29) | {H}-[CyA]YCQKW[Nle]W TCDEKRACC[Pra]GLVCKL WCRKEI{Amide} |

TABLE 5-continued

Amino acid sequences of JzTx-V and JzTx-V peptide analogs.

| SEQ ID NO. | Designation | Amino Acid Sequence |
|---|---|---|
| 950 | CyA-[Nle6;Glu11,28;Pra17;Gln22] JzTx-V(1-29) | {H}-[CyA]YCQKW[Nle]W TCDEKRACC[Pra]GLRCQL WCRKEI{Amide} |
| 951 | CyA-[Nle6;Glu11,28;Pra17;Tyr27] JzTx-V(1-29) | {H}-[CyA]YCQKW[Nle]W TCDEKRACC[Pra]GLRCKL WCRYEI{Amide} |
| 952 | CyA-[Nle6;Glu11,28;Pra17;Leu27] JzTx-V(1-29) | {H}-[CyA]YCQKW[Nle]W TCDEKRACC[Pra]GLRCKL WCRLEI{Amide} |
| 953 | CyA-[Nle6;Glu12,28;Pra17;Asp18] JzTx-V(1-29) | {H}-[CyA]YCQKW[Nle]W TCDSERACC[Pra]DLRCKL WCRKEI{Amide} |
| 954 | CyA-[Nle6;Glu12,28;Pra17;Val20] JzTx-V(1-29) | {H}-[CyA]YCQKW[Nle]W TCDSERACC[Pra]GLVCKL WCRKEI{Amide} |
| 955 | CyA-[Nle6;Glu12,28;Pra17;Gln22] JzTx-V(1-29) | {H}-[CyA]YCQKW[Nle]W TCDSERACC[Pra]GLRCQL WCRKEI{Amide} |
| 956 | CyA-[Nle6;Glu12,28;Pra17;Tyr27] PzTx-V(1-29) | {H}-[CyA]YCQKW[Nle]W TCDSERACC[Pra]GLRCKL WCRYEI{Amide} |
| 957 | CyA-[Nle6;Glu12,28;Pra17;Leu27] JzTx-V(1-29) | {H}-[CyA]YCQKW[Nle]W TCDSERACC[Pra]GLRCKL WCRLEI{Amide} |
| 958 | CyA-[Nle6;Ala12;Glu14,28;Pra17] JzTx-V(1-29) | {H}-[CyA]YCQKW[Nle]W TCDSARECC[Pra]GLRCKL WCRKEI{Amide} |
| 959 | CyA-[Nle6;Glu14,28;Pra17;Asp18] JzTx-V(1-29) | {H}-[CyA]YCQKW[Nle]W TCDSKRECC[Pra]DLRCKL WCRKEI{Amide} |
| 960 | CyA-+Nle6;Glu14,28;Pral 7;Val20] JzTx-V(1-29) | {H}-[CyA]YCQKW[Nle]W TCDSKRECC[Pra]GLVCKL WCRKEI{Amide} |
| 961 | CyA-[Nle6;Glu14,28;Pra17;Gln22] JzTx-V(1-29) | {H}-[CyA]YCQKW[Nle]W TCDSKRECC[Pra]GLRCQL WCRKEI{Amide} |
| 962 | CyA-[Nle6;Glu14,28;Pra17;Tyr27] JzTx-V(1-29) | {H}-[CyA]YCQKW[Nle]W TCDSKRECC[Pra]GLRCKL WCRYEI{Amide} |
| 963 | CyA-[Nle6;Glu14,28;Pra17;Leu27] JzTx-V(1-29) | {H}-[CyA]YCQKW[Nle]W TCDSKRECC[Pra]GLRCKL WCRLEI{Amide} |
| 964 | CyA-[Nle6;Ala12;Pra17;Val20;Glu28] JzTx-V(1-29) | {H}-[CyA]YCQKW[Nle]W TCDSARACC[Pra]GLVCKL WCRKEI{Amide} |
| 965 | CyA-[Nle6;Pra17;Asp18;Val20;Glu28] JzTx-V(1-29) | {H}-[CyA]YCQKW[Nle]W TCDSKRACC[Pra]DLVCKL WCRKEI{Amide} |
| 966 | CyA-[Nle6;Pra17;Val20;Gln22;Glu28] JzTx-V(1-29) | {H}-[CyA]YCQKW[Nle]W TCDSKRACC[Pra]GLVCQL WCRKEI{Amide} |
| 967 | CyA-[Nle6;Pra17;Val20;Tyr27;Glu28] JzTx-V(1-29) | {H}-[CyA]YCQKW[Nle]W TCDSKRACC[Pra]GLVCKL WCRYEI{Amide} |

TABLE 5-continued

Amino acid sequences of JzTx-V and JzTx-V peptide analogs.

| SEQ ID NO. | Designation | Amino Acid Sequence |
|---|---|---|
| 968 | CyA-[Nle6;Pra17;Val20;Leu27;Glu28] JzTx-V(1-29) | {H}-[CyA]YCQKW[Nle]W TCDSKRACC[Pra]GLVCKL WCRLEI{Amide} |
| 969 | CyA-[Nle6;Glu11,12,28;Pra17] JzTx-V(1-29) | {H}-[CyA]YCQKW[Nle]W TCDEERACC[Pra]GLRCKL WCRKEI{Amide} |
| 970 | CyA-[Nle6;Glu11,12,28;Pra17;Asp18] JzTx-V(1-29) | {H}-[CyA]YCQKW[Nle]W TCDEERACC[Pra]DLRCKL WCRKEI{Amide} |
| 971 | CyA-[Nle6;Glu11,12,28;Pra17;Val20] JzTx-V(1-29) | {H}-[CyA]YCQKW[Nle]W TCDEERACC[Pra]GLVCKL WCRKEI{Amide} |
| 972 | CyA-]Nle6;Glu11,12,28;Pra17;Gln22] JzTx-V(1-29) | {H}-[CyA]YCQKW[Nle]W TCDEERACC[Pra]GLRCQL WCRKEI{Amide} |
| 973 | CyA-[Nle6;Glu11,12,28;Pra17;Tyr27] JzTx-V(1-29) | {H}-[CyA]YCQKW[Nle]W TCDEERACC[Pra]GLRCKL WCRYEI{Amide} |
| 974 | CyA-[Nle6;Glu11,12,28;Pra17;Leu27] JzTx-V(1-29) | {H}-[CyA]YCQKW[Nle]W TCDEERACC[Pra]GLRCKL WCRLEI{Amide} |
| 975 | CyA-[Nle6;Glu11,12,28;Pra17;Val20;Gln22] JzTx-V(1-29) | {H}-[CyA]YCQKW[Nle]W TCDEERACC[Pra]GLVCQL WCRKEI{Amide} |
| 976 | CyA-[Nle6;Glu11,12,28;Pra17;Val20;Tyr27] JzTx-V(1-29) | {H}-[CyA]YCQKW[Nle]W TCDEERACC[Pra]GLVCKL WCRYEI{Amide} |
| 977 | CyA-[Nle6;Glu11,12,28;Pra17;Val20;Leu27] JzTx-V(1-29) | {H}-[CyA]YCQKW[Nle]W TCDEERACC[Pra]GLVCKL WCRLEI{Amide} |
| 978 | CyA-[Nle6;Glu12,18,28;Pra17;Val20] JzTx-V(1-29) | {H}-[CyA]YCQKW[Nle]W TCDSERACC[Pra]ELVCKL WCRKEI{Amide} |
| 979 | CyA-[Nle6;Glu12,18,28;Pra17;Gln22] JzTx-V(1-29) | {H}-[CyA]YCQKW[Nle]W TCDSERACC[Pra]ELRCQL WCRKEI{Amide} |
| 980 | CyA-[Nle6;Glu12,18,28;Pra17;Tyr27] JzTx-V(1-29) | {H}-[CyA]YCQKW[Nle]W TCDSERACC[Pra]ELRCKL WCRYEI{Amide} |
| 981 | CyA-[Nle6;Glu12,18,28;Pra17;Leu27] JzTx-V(1-29) | {H}-[CyA]YCQKW[Nle]W TCDSERACC[Pra]ELRCKL WCRLEI{Amide} |
| 982 | CyA-[Nle6;Glu12,18,28;Pra17;Val20;Gln22] JzTx-V(1-29) | {H}-[CyA]YCQKW[Nle]W TCDSERACC[Pra]ELVCQL WCRKEI{Amide} |
| 983 | CyA-[Nle6;Glu12,18,28;Pra17;Val20;Tyr27] JzTx-V(1-29) | {H}-[CyA]YCQKW[Nle]W TCDSERACC[Pra]ELVCKL WCRYEI{Amide} |
| 984 | CyA-[Nle6;Glu12,18,28;Pra17;Val20;Leu27] JzTx-V(1-29) | {H}-[CyA]YCQKW[Nle]W TCDSERACC[Pra]ELVCKL WCRLEI{Amide} |
| 985 | CyA-[Nle6;Pra17;Tyr27;Asn28;Leu29] JzTx-V(1-29) | {H}-[CyA]YCQKW[Nle]W TCDSKRACC[Pra]GLRCKL WCRYNL{Amide} |

TABLE 5-continued

Amino acid sequences of JzTx-V and JzTx-V peptide analogs.

| SEQ ID NO. | Designation | Amino Acid Sequence |
|---|---|---|
| 986 | Pra-[Nle6;Ala12;Glu28]JzTx-V(1-29) | {H}-[Pra]YCQKW[Nle]W TCDSARACCEGLRCKLWCRK EI{Amide} |
| 987 | Pra-[Nle6;Asp18;Glu28]JzTx-V(1-29) | {H}-[Pra]YCQKW[Nle]W TCDSKRACCEDLRCKLWCRK EI{Amide} |
| 988 | Pra-[Nle6;Tyr27;Glu28]JzTx-V(1-29) | {H}-[Pra]YCQKW[Nle]W TCDSKRACCEGLRCKLWCRY EI{Amide} |
| 989 | Pra-[Nle6;Leu27;Glu28]JzTx-V(1-29) | {H}-[Pra]YCQKW[Nle]W TCDSKRACCEGLRCKLWCRL EI{Amide} |
| 990 | Pra-[Glu1,28;Nle6;Ala12]JzTx-V(1-29) | {H}-[Pra]ECQKW[Nle]W TCDSARACCEGLRCKLWCRK EI{Amide} |
| 991 | Pra-[Glu1,28;Nle6;Asp18]JzTx-V(1-29) | {H}-[Pra]ECQKW[Nle]W TCDSKRACCEDLRCKLWCRK EI{Amide} |
| 992 | Pra-[Glu1,28;Nle6;Val20]JzTx-V(1-29) | {H}-[Pra]ECQKW[Nle]W TCDSKRACCEGLVCKLWCRK EI{Amide} |
| 993 | Pra-[Glu1,28;Nle6;Gln22]JzTx-V(1-29) | {H}-[Pra]ECQKW[Nle]W TCDSKRACCEGLRCQLWCRK EI{Amide} |
| 994 | Pra-[Glu1,28;Nle6;Tyr27]JzTx-V(1-29) | {H}-[Pra]ECQKW[Nle]W TCDSKRACCEGLRCKLWCRY EI{Amide} |
| 995 | Pra-[Glu1,28;Nle6;Leu27]JzTx-V(1-29) | {H}-[Pra]ECQKW[Nle]W TCDSKRACCEGLRCKLWCRL EI{Amide} |
| 996 | Pra-[Nle6;Glu11,28;Ala12]JzTx-V(1-29) | {H}-[Pra]YCQKW[Nle]W TCDEARACCEGLRCKLWCRK EI{Amide} |
| 997 | Pra-[Nle6;Glu11,28;Asp18]JzTx-V(1-29) | {H}-[Pra]YCQKW[Nle]W TCDEKRACCEDLRCKLWCRK EI{Amide} |
| 998 | Pra-[Nle6;Glu11,28;Val20]JzTx-V(1-29) | {H}-[Pra]YCQKW[Nle]W TCDEKRACCEGLVCKLWCRK EI{Amide} |
| 999 | Pra-[Nle6;Glu11,28;Gln22]JzTx-V(1-29) | {H}-[Pra]YCQKW[Nle]W TCDEKRACCEGLRCQLWCRK EI{Amide} |
| 1000 | Pra-[Nle6;Glu11,28;Tyr27]JzTx-V(1-29) | {H}-[Pra]YCQKW[Nle]W TCDEKRACCEGLRCKLWCRY EI{Amide} |
| 1001 | Pra-[Nle6;Glu11,28;Leu27]JzTx-V(1-29) | {H}-[Pra]YCQKW[Nle]W TCDEKRACCEGLRCKLWCRL EI{Amide} |
| 1002 | Pra-[Nle6;Glu12,28;Asp18]JzTx-V(1-29) | {H}-[Pra]YCQKW[Nle]W TCDSERACCEDLRCKLWCRK EI{Amide} |
| 1003 | Pra-[Nle6;Glu12,28;Val20]JzTx-V(1-29) | {H}-[Pra]YCQKW[Nle]W TCDSERACCEGLVCKLWCRK EI{Amide} |

TABLE 5-continued

Amino acid sequences of JzTx-V and JzTx-V peptide analogs.

| SEQ ID NO. | Designation | Amino Acid Sequence |
|---|---|---|
| 1004 | Pra-[Nle6;Glu12,28;Gln22]JzTx-V(1-29) | {H}-[Pra]YCQKW[Nle]W TCDSERACCEGLRCQLWCRK EI{Amide} |
| 1005 | Pra-[Nle6;Glu12,28;Tyr27]JzTx-V(1-29) | {H}-[Pra]YCQKW[Nle]W TCDSERACCEGLRCKLWCRY EI{Amide} |
| 1006 | Pra-[Nle6;Glu12,28;Leu27]JzTx-V(1-29) | {H}-[Pra]YCQKW[Nle]W TCDSERACCEGLRCKLWCRL EI{Amide} |
| 1007 | Pra-[Nle6;Ala12;Glu13,28]JzTx-V(1-29) | {H}-[Pra]YCQKW[Nle]W TCDSAEACCEGLRCKLWCRK EI{Amide} |
| 1008 | Pra-[Nle6;Glu13,28;Asp18]JzTx-V(1-29) | {H}-[Pra]YCQKW[Nle]W TCDSKEACCEDLRCKLWCRK EI{Amide} |
| 1009 | Pra-[Nle6;Glu13,28;Val20]JzTx-V(1-29) | {H}-[Pra]YCQKW[Nle]W TCDSKEACCEGLVCKLWCRK EI{Amide} |
| 1010 | Pra-[Nle6;Glu13,28;Gln22]JzTx-V(1-29) | {H}-[Pra]YCQKW[Nle]W TCDSKEACCEGLRCQLWCRK EI{Amide} |
| 1011 | Pra-[Nle6;Glu13,28;Tyr27]JzTx-V(1-29) | {H}-[Pra]YCQKW[Nle]W TCDSKEACCEGLRCKLWCRY EI{Amide} |
| 1012 | Pra-[Nle6;Glu13,28;Leu27]JzTx-V(1-29) | {H}-[Pra]YCQKW[Nle]W TCDSKEACCEGLRCKLWCRL EI{Amide} |
| 1013 | Pra-[Nle6;Ala12;Val20;Glu28] JzTx-V(1-29) | {H}-[Pra]YCQKW[Nle]W TCDSARACCEGLVCKLWCRK EI{Amide} |
| 1014 | Pra-[Nle6;Asp18;Val20;Glu28] JzTx-V(1-29) | {H}-[Pra]YCQKW[Nle]W TCDSKRACCEDLVCKLWCRK EI{Amide} |
| 1015 | Pra-[Nle6;Val20;Gln22;Glu28] JzTx-V(1-29) | {H}-[Pra]YCQKW[Nle]W TCDSKRACCEGLVCQLWCRK EI{Amide} |
| 1016 | Pra-[Nle6;Val20;Tyr27;Glu28] JzTx-V(1-29) | {H}-[Pra]YCQKW[Nle]W TCDSKRACCEGLVCKLWCRY EI{Amide} |
| 1017 | Pra-[Nle6;Val20;Leu27;Glu28] JzTx-V(1-29) | {H}-[Pra]YCQKW[Nle]W TCDSKRACCEGLVCKLWCRL EI{Amide} |
| 1018 | Pra-[Nle6;Glu11,12,28;Asp18] JzTx-V(1-29) | {H}-[Pra]YCQKW[Nle]W TCDEERACCEDLRCKLWCRK EI{Amide} |
| 1019 | Pra-[Nle6;Glu11,12,28;Val20] JzTx-V(1-29) | {H}-[Pra]YCQKW[Nle]W TCDEERACCEGLVCKLWCRK EI{Amide} |
| 1020 | Pra-[Nle6;Glu11,12,28;Gln22] JzTx-V(1-29) | {H}-[Pra]YCQKW[Nle]W TCDEERACCEGLRCQLWCRK EI{Amide} |
| 1021 | Pra-[Nle6;Glu11,12,28;Tyr27] JzTx-V(1-29) | {H}-[Pra]YCQKW[Nle]W TCDEERACCEGLRCKLWCRY EI{Amide} |

TABLE 5-continued

Amino acid sequences of JzTx-V and JzTx-V peptide analogs.

| SEQ ID NO. | Designation | Amino Acid Sequence |
|---|---|---|
| 1022 | Pra-[Nle6;Glu11,12,28;Leu27] JzTx-V(1-29) | {H}-[Pra]YCQKW[Nle]W TCDEERACCEGLRCKLWCRL EI{Amide} |
| 1023 | Pra-[Nle6;Glu11,12,28;Val20;Gln22] JzTx-V(1-29) | {H}-[Pra]YCQKW[Nle]W TCDEERACCEGLVCQLWCRK EI{Amide} |
| 1024 | Pra-[Nle6;Glu11,12,28;Val20;Tyr27] JzTx-V(1-29) | {H}-[Pra]YCQKW[Nle]W TCDEERACCEGLVCKLWCRY EI{Amide} |
| 1025 | Pra-[Nle6;Glu11,12,28;Val20;Leu27] JzTx-V(1-29) | {H}-[Pra]YCQKW[Nle]W TCDEERACCEGLVCKLWCRL EI{Amide} |
| 1026 | Pra-[Nle6;Glu12,18,28;Val20] JzTx-V(1-29) | {H}-[Pra]YCQKW[Nle]W TCDSERACCEELVCKLWCRK EI{Amide} |
| 1027 | Pra-[Nle6;Glu12,18,28;Gln22] JzTx-V(1-29) | {H}-[Pra]YCQKW[Nle]W TCDSERACCEELRCQLWCRK EI{Amide} |
| 1028 | Pra-[Nle6;Glu12,18,28;Tyr27] JzTx-V(1-29) | {H}-[Pra]YCQKW[Nle]W TCDSERACCEELRCKLWCRY EI{Amide} |
| 1029 | Pra-[Nle6;Glu12,18,28;Leu27] JzTx-V(1-29) | {H}-[Pra]YCQKW[Nle]W TCDSERACCEELRCKLWCRL EI{Amide} |
| 1030 | Pra-[Nle6;Glu12,18,28;Val20;Gln22] JzTx-V(1-29) | {H}-[Pra]YCQKW[Nle]W TCDSERACCEELVCQLWCRK EI{Amide} |
| 1031 | Pra-[Nle6;Glu12,18,28;Val20;Tyr27] JzTx-V(1-29) | {H}-[Pra]YCQKW[Nle]W TCDSERACCEELVCKLWCRY EI{Amide} |
| 1032 | Pra-[Nle6;Glu12,18,28;Val20;Leu27] JzTx-V(1-29) | {H}-[Pra]YCQKW[Nle]W TCDSERACCEELVCKLWCRL EI{Amide} |
| 1033 | Pra-[Nle6;Tyr27;Asn28;Leu29] JzTx-V(1-29) | {H}-[Pra]YCQKW[Nle]W TCDSKRACCEGLRCKLWCRY NL{Amide} |
| 1034 | CyA-[Nle6;Glu11;Pra17]JzTx-V(1-29) | {H}-[CyA]YCQKW[Nle]W TCDEKRACC[Pra]GLRCKL WCRKII{Amide} |
| 1035 | CyA-[Nle6;Ala12;Pra17]JzTx-V(1-29) | {H}-[CyA]YCQKW[Nle]W TCDSARACC[Pra]GLRCKL WCRKII{Amide} |
| 1036 | CyA-[Nle6;Pra17;Asp18]JzTx-V(1-29) | {H}-[CyA]YCQKW[Nle]W TCDSKRACC[Pra]DLRCKL WCRKII{Amide} |
| 1037 | CyA-[Nle6;Pra17;Val20]JzTx-V(1-29) | {H}-[CyA]YCQKW[Nle]W TCDSKRACC[Pra]GLVCKL WCRKII{Amide} |
| 1038 | CyA-[Nle6;Pra17;Gln22]JzTx-V(1-29) | {H}-[CyA]YCQKW[Nle]W TCDSKRACC[Pra]GLRCQL WCRKII{Amide} |
| 1039 | CyA-[Nle6;Pra17;Tyr27]JzTx-V(1-29) | {H}-[CyA]YCQKW[Nle]W TCDSKRACC[Pra]GLRCKL WCRYII{Amide} |

TABLE 5-continued

Amino acid sequences of JzTx-V and JzTx-V peptide analogs.

| SEQ ID NO. | Designation | Amino Acid Sequence |
|---|---|---|
| 1040 | CyA-[Nle6;Pra17;Leu27]JzTx-V(1-29) | {H}-[CyA]YCQKW[Nle]W TCDSKRACC[Pra]GLRCKL WCRLII{Amide} |
| 1041 | CyA-[Glu1;Nle6;Ala12;Pra17] JzTx-V(1-29) | {H}-[CyA]ECQKW[Nle]W TCDSARACC[Pra]GLRCKL WCRKII{Amide} |
| 1042 | CyA-[Glu1;Nle6;Pra17;Asp18] JzTx-V(1-29) | {H}-[CyA]ECQKW[Nle]W TCDSKRACC[Pra]DLRCKL WCRKII{Amide} |
| 1043 | CyA-[Glu1;Nle6;Pra17;Val20] JzTx-V(1-29) | {H}-[CyA]ECQKW[Nle]W TCDSKRACC[Pra]GLVCKL WCRKII{Amide} |
| 1044 | CyA-[Glu1;Nle6;Pra17;Gln22] JzTx-V(1-29) | {H}-[CyA]ECQKW[Nle]W TCDSKRACC[Pra]GLRCQL WCRKII{Amide} |
| 1045 | CyA-[Glu1;Nle6;Pra17;Tyr27] JzTx-V(1-29) | {H}-[CyA]ECQKW[Nle]W TCDSKRACC[Pra]GLRCKL WCRYII{Amide} |
| 1046 | CyA-[Glu1;Nle6;Pra17;Leu27] JzTx-V(1-29) | {H}-[CyA]ECQKW[Nle]W TCDSKRACC[Pra]GLRCKL WCRLII{Amide} |
| 1047 | CyA-[Nle6;Glu11;Ala12;Pra17] JzTx-V(1-29) | {H}-[CyA]YCQKW[Nle]W TCDEARACC[Pra]GLRCKL WCRKII{Amide} |
| 1048 | CyA-[Nle6;Glu11;Pra17;Asp18] JzTx-V(1-29) | {H}-[CyA]YCQKW[Nle]W TCDEKRACC[Pra]DLRCKL WCRKII{Amide} |
| 1049 | CyA-[Nle6;Glu11;Pra17;Val20] JzTx-V(1-29) | {H}-[CyA]YCQKW[Nle]W TCDEKRACC[Pra]GLVCKL WCRKII{Amide} |
| 1050 | CyA-[Nle6;Glu11;Pra17;Gln22] JzTx-V(1-29) | {H}-[CyA]YCQKW[Nle]W TCDEKRACC[Pra]GLRCQL WCRKII{Amide} |
| 1051 | CyA-[Nle6;Glu11;Pra17;Tyr27] JzTx-V(1-29) | {H}-[CyA]YCQKW[Nle]W TCDEKRACC[Pra]GLRCKL WCRYII{Amide} |
| 1052 | CyA-[Nle6;Glu11;Pra17;Leu27] JzTx-V(1-29) | {H}-[CyA]YCQKW[Nle]W TCDEKRACC[Pra]GLRCKL WCRLII{Amide} |
| 1053 | CyA-[Nle6;Glu12;Pra17;Asp18] JzTx-V(1-29) | {H}-[CyA]YCQKW[Nle]W TCDSERACC[Pra]DLRCKL WCRKII{Amide} |
| 1054 | CyA-[Nle6;Glu12;Pra17;Val20] JzTx-V(1-29) | {H}-[CyA]YCQKW[Nle]W TCDSERACC[Pra]GLVCKL WCRKII{Amide} |
| 1055 | CyA-[Nle6;Glu12;Pra17;Gln22] JzTx-V(1-29) | {H}-[CyA]YCQKW[Nle]W TCDSERACC[Pra]GLRCQL WCRKII{Amide} |
| 1056 | CyA-[Nle6;Glu12;Pra17;Tyr27] JzTx-V(1-29) | {H}-[CyA]YCQKW[Nle]W TCDSERACC[Pra]GLRCKL WCRYII{Amide} |
| 1057 | CyA-[Nle6;Glu12;Pra17;Leu27] JzTx-V(1-29) | {H}-[CyA]YCQKW[Nle]W TCDSERACC[Pra]GLRCKL WCRLII{Amide} |

TABLE 5-continued

Amino acid sequences of JzTx-V and JzTx-V peptide analogs.

| SEQ ID NO. | Designation | Amino Acid Sequence |
|---|---|---|
| 1058 | CyA-[Nle6;Ala12;Glu14;Pra17] JzTx-V(1-29) | {H}-[CyA]YCQKW[Nle]W TCDSARECC[Pra]GLRCKL WCRKII{Amide} |
| 1059 | CyA-[Nle6;Glu14;Pra17;Asp18] JzTx-V(1-29) | {H}-[CyA]YCQKW[Nle]W TCDSKRECC[Pra]DLRCKL WCRKII{Amide} |
| 1060 | CyA-[Nle6;Glu14;Pra17;Val20] JzTx-V(1-29) | {H}-[CyA]YCQKW[Nle]W TCDSKRECC[Pra]GLVCKL WCRKII{Amide} |
| 1061 | CyA-[Nle6;Glu14;Pra17;Gln22] JzTx-V(1-29) | {H}-[CyA]YCQKW[Nle]W TCDSKRECC[Pra]GLRCQL WCRKII{Amide} |
| 1062 | CyA-[Nle6;Glu14;Pra17;Tyr27] JzTx-V(1-29) | {H}-[CyA]YCQKW[Nle]W TCDSKRECC[Pra]GLRCKL WCRYII{Amide} |
| 1063 | CyA-[Nle6;Glu14;Pra17;Leu27] JzTx-V(1-29) | {H}-[CyA]YCQKW[Nle]W TCDSKRECC[Pra]GLRCKL WCRLII{Amide} |
| 1064 | CyA-[Nle6;Ala12;Pra17;Val20] JzTx-V(1-29) | {H}-[CyA]YCQKW[Nle]W TCDSARACC[Pra]GLVCKL WCRKII{Amide} |
| 1065 | CyA-[Nle6;Pra17;Asp18;Val20] JzTx-V(1-29) | {H}-[CyA]YCQKW[Nle]W TCDSKRACC[Pra]DLVCKL WCRKII{Amide} |
| 1066 | CyA-[Nle6;Pra17;Val20;Gln22] JzTx-V(1-29) | {H}-[CyA]YCQKW[Nle]W TCDSKRACC[Pra]GLVCQL WCRKII{Amide} |
| 1067 | CyA-[Nle6;Pra17;Val20;Tyr27] JzTx-V(1-29) | {H}-[CyA]YCQKW[Nle]W TCDSKRACC[Pra]GLVCKL WCRYII{Amide} |
| 1068 | CyA-[Nle6;Pra17;Val20;Leu27] JzTx-V(1-29) | {H}-[CyA]YCQKW[Nle]W TCDSKRACC[Pra]GLVCKL WCRLII{Amide} |
| 1069 | CyA-[Nle6;Glu11,12;Pra17] JzTx-V(1-29) | {H}-[CyA]YCQKW[Nle]W TCDEERACC[Pra]GLRCKL WCRKII{Amide} |
| 1070 | CyA-[Nle6;Glu11,12;Pra17;Asp18] JzTx-V(1-29) | {H}-[CyA]YCQKW[Nle]W TCDEERACC[Pra]DLRCKL WCRKII{Amide} |
| 1071 | CyA-[Nle6;Glu11,12;Pra17;Val20] JzTx-V(1-29) | {H}-[CyA]YCQKW[Nle]W TCDEERACC[Pra]GLVCKL WCRKII{Amide} |
| 1072 | CyA-[Nle6;Glu11,12;Pra17;Gln22] JzTx-V(1-29) | {H}-[CyA]YCQKW[Nle]W TCDEERACC[Pra]GLRCQL WCRKII{Amide} |
| 1073 | CyA-[Nle6;Glu11,12;Pra17;Tyr27] JzTx-V(1-29) | {H}-[CyA]YCQKW[Nle]W TCDEERACC[Pra]GLRCKL WCRYII{Amide} |
| 1074 | CyA-[Nle6;Glu11,12;Pra17;Leu27] JzTx-V(1-29) | {H}-[CyA]YCQKW[Nle]W TCDEERACC[Pra]GLRCKL WCRLII{Amide} |
| 1075 | CyA-[Nle6;Glu11,12;Pra17;Val20;Gln22] JzTx-V(1-29) | {H}-[CyA]YCQKW[Nle]W TCDEERACC[Pra]GLVCQL WCRKII{Amide} |

TABLE 5-continued

Amino acid sequences of JzTx-V and JzTx-V peptide analogs.

| SEQ ID NO. | Designation | Amino Acid Sequence |
|---|---|---|
| 1076 | CyA-[Nle6;Glu11,12;Pra17;Val20;Tyr27] JzTx-V(1-29) | {H}-[CyA]YCQKW[Nle]W TCDEERACC[Pra]GLVCKL WCRYII{Amide} |
| 1077 | CyA-[Nle6;Glu11,12;Pra17;Val20;Leu27] JzTx-V(1-29) | {H}-[CyA]YCQKW[Nle]W TCDEERACC[Pra]GLVCKL WCRLII{Amide} |
| 1078 | CyA-[Nle6;Glu12,18;Pra17;Val20] JzTx-V(1-29) | {H}-[CyA]YCQKW[Nle]W TCDSERACC[Pra]ELVCKL WCRKII{Amide} |
| 1079 | CyA-[Nle6;Glu12,18;Pra17;Gln22] JzTx-V(1-29) | {H}-[CyA]YCQKW[Nle]W TCDSERACC[Pra]ELRCQL WCRKII{Amide} |
| 1080 | CyA-[Nle6;Glu12,18;Pra17;Tyr27] JzTx-V(1-29) | {H}-[CyA]YCQKW[Nle]W TCDSERACC[Pra]ELRCKL WCRYII{Amide} |
| 1081 | CyA-[Nle6;Glu12,18;Pra17;Leu27] JzTx-V(1-29) | {H}-[CyA]YCQKW[Nle]W TCDSERACC[Pra]ELRCKL WCRLII{Amide} |
| 1082 | CyA-[Nle6;Glu12,18;Pra17;Val20;Gln22] JzTx-V(1-29) | {H}-[CyA]YCQKW[Nle]W TCDSERACC[Pra]ELVCQL WCRKII{Amide} |
| 1083 | CyA-[Nle6;Glu12,18;Pra17;Val20;Tyr27] JzTx-V(1-29) | {H}-[CyA]YCQKW[Nle]W TCDSERACC[Pra]ELVCKL WCRYII{Amide} |
| 1084 | CyA-[Nle6;Glu12,18;Pra17;Val20;Leu27] JzTx-V(1-29) | {H}-[CyA]YCQKW[Nle]W TCDSERACC[Pra]ELVCKL WCRLII{Amide} |
| 1085 | Pra-[Nle6;Glu11]JzTx-V(1-29) | {H}-[Pra]YCQKW[Nle]W TCDEKRACCEGLRCKLWCRK II{Amide} |
| 1086 | Pra-[Nle6;Glu14]JzTx-V(1-29) | {H}-[Pra]YCQKW[Nle]W TCDSKRECCEGLRCKLWCRK II{Amide} |
| 1087 | Pra-[Nle6;Ala12]JzTx-V(1-29) | {H}-[Pra]YCQKW[Nle]W TCDSARACCEGLRCKLWCRK II{Amide} |
| 1088 | Pra-[Nle6;Asp18]JzTx-V(1-29) | {H}-[Pra]YCQKW[Nle]W TCDSKRACCEDLRCKLWCRK II{Amide} |
| 1089 | Pra-[Nle6;Gln22]JzTx-V(1-29) | {H}-[Pra]YCQKW[Nle]W TCDSKRACCEGLRCQLWCRK II{Amide} |
| 1090 | Pra-[Nle6;Tyr27]JzTx-V(1-29) | {H}-[Pra]YCQKW[Nle]W TCDSKRACCEGLRCKLWCRY II{Amide} |
| 1091 | Pra-[Nle6;Leu27]JzTx-V(1-29) | {H}-[Pra]YCQKW[Nle]W TCDSKRACCEGLRCKLWCRL II{Amide} |
| 1092 | Pra-[Glu1;Nle6;Ala12]JzTx-V(1-29) | {H}-[Pra]ECQKW[Nle]W TCDSARACCEGLRCKLWCRK II{Amide} |
| 1093 | Pra-[Glu1;Nle6;Asp18]JzTx-V(1-29) | {H}-[Pra]ECQKW[Nle]W TCDSKRACCEDLRCKLWCRK II{Amide} |

TABLE 5-continued

Amino acid sequences of JzTx-V and JzTx-V peptide analogs.

| SEQ ID NO. | Designation | Amino Acid Sequence |
|---|---|---|
| 1094 | Pra-[Glu1;Nle6;Val20]JzTx-V(1-29) | {H}-[Pra]ECQKW[Nle]W TCDSKRACCEGLVCKLWCRK II{Amide} |
| 1095 | Pra-[Glu1;Nle6;Gln22]JzTx-V(1-29) | {H}-[Pra]ECQKW[Nle]W TCDSKRACCEGLRCQLWCRK II{Amide} |
| 1096 | Pra-[Glu1;Nle6;Tyr27]JzTx-V(1-29) | {H}-[Pra]ECQKW[Nle]W TCDSKRACCEGLRCKLWCRY II{Amide} |
| 1097 | Pra-[Glu1;Nle6;Leu27]JzTx-V(1-29) | {H}-[Pra]ECQKW[Nle]W TCDSKRACCEGLRCKLWCRL II{Amide} |
| 1098 | Pra-[Nle6;Glu11;Ala12]JzTx-V(1-29) | {H}-[Pra]YCQKW[Nle]W TCDEARACCEGLRCKLWCRK II{Amide} |
| 1099 | Pra-[Nle6;Glu11;Asp18]JzTx-V(1-29) | {H}-[Pra]YCQKW[Nle]W TCDEKRACCEDLRCKLWCRK II{Amide} |
| 1100 | Pra-[Nle6;Glu11;Val20]JzTx-V(1-29) | {H}-[Pra]YCQKW[Nle]W TCDEKRACCEGLVCKLWCRK II{Amide} |
| 1101 | Pra-[Nle6;Glu11;Gln22]JzTx-V(1-29) | {H}-[Pra]YCQKW[Nle]W TCDEKRACCEGLRCQLWCRK II{Amide} |
| 1102 | Pra-[Nle6;Glu11;Tyr27]JzTx-V(1-29) | {H}-[Pra]YCQKW[Nle]W TCDEKRACCEGLRCKLWCRY II{Amide} |
| 1103 | Pra-[Nle6;Glu11;Leu27]JzTx-V(1-29) | {H}-[Pra]YCQKW[Nle]W TCDEKRACCEGLRCKLWCRL II{Amide} |
| 1104 | Pra-[Nle6;Glu12;Asp18]JzTx-V(1-29) | {H}-[Pra]YCQKW[Nle]W TCDSERACCEDLRCKLWCRK II{Amide} |
| 1105 | Pra-[Nle6;Glu12;Val20]JzTx-V(1-29) | {H}-[Pra]YCQKW[Nle]W TCDSERACCEGLVCKLWCRK II{Amide} |
| 1106 | Pra-[Nle6;Glu12;Gln22]JzTx-V(1-29) | {H}-[Pra]YCQKW[Nle]W TCDSERACCEGLRCQLWCRK II{Amide} |
| 1107 | Pra-[Nle6;Glu12;Tyr27]JzTx-V(1-29) | {H}-[Pra]YCQKW[Nle]W TCDSERACCEGLRCKLWCRY II{Amide} |
| 1108 | Pra-[Nle6;Glu12;Leu27]JzTx-V(1-29) | {H}-[Pra]YCQKW[Nle]W TCDSERACCEGLRCKLWCRL II{Amide} |
| 1109 | Pra-[Nle6;Ala12;Glu13]JzTx-V(1-29) | {H}-[Pra]YCQKW[Nle]W TCDSAEACCEGLRCKLWCRK II{Amide} |
| 1110 | Pra-[Nle6;Glu13;Asp18]JzTx-V(1-29) | {H}-[Pra]YCQKW[Nle]W TCDSKEACCEDLRCKLWCRK II{Amide} |
| 1111 | Pra-[Nle6;Glu13;Val20]JzTx-V(1-29) | {H}-[Pra]YCQKW[Nle]W TCDSKEACCEGLVCKLWCRK II{Amide} |

TABLE 5-continued

Amino acid sequences of JzTx-V and JzTx-V peptide analogs.

| SEQ ID NO. | Designation | Amino Acid Sequence |
|---|---|---|
| 1112 | Pra-[Nle6;Glu13;Gln22]JzTx-V(1-29) | {H}-[Pra]YCQKW[Nle]W TCDSKEACCEGLRCQLWCRK II{Amide} |
| 1113 | Pra-[Nle6;Glu13;Tyr27]JzTx-V(1-29) | {H}-[Pra]YCQKW[Nle]W TCDSKEACCEGLRCKLWCRY II{Amide} |
| 1114 | Pra-[Nle6;Glu13;Leu27]JzTx-V(1-29) | {H}-[Pra]YCQKW[Nle]W TCDSKEACCEGLRCKLWCRL II{Amide} |
| 1115 | Pra-[Nle6;Ala12;Val20]JzTx-V(1-29) | {H}-[Pra]YCQKW[Nle]W TCDSARACCEGLVCKLWCRK II{Amide} |
| 1116 | Pra-[Nle6;Asp18;Val20]JzTx-V(1-29) | {H}-[Pra]YCQKW[Nle]W TCDSKRACCEDLVCKLWCRK II{Amide} |
| 1117 | Pra-[Nle6;Val20;Gln22]JzTx-V(1-29) | {H}-[Pra]YCQKW[Nle]W TCDSKRACCEGLVCQLWCRK II{Amide} |
| 1118 | Pra-[Nle6;Val20;Tyr27]JzTx-V(1-29) | {H}-[Pra]YCQKW[Nle]W TCDSKRACCEGLVCKLWCRY II{Amide} |
| 1119 | Pra-[Nle6;Val20;Leu27]JzTx-V(1-29) | {H}-[Pra]YCQKW[Nle]W TCDSKRACCEGLVCKLWCRL II{Amide} |
| 1120 | Pra-[Nle6;Glu11,12]JzTx-V(1-29) | {H}-[Pra]YCQKW[Nle]W TCDEERACCEGLRCKLWCRK II{Amide} |
| 1121 | Pra-[Nle6;Glu11,12;Asp18] JzTx-V(1-29) | {H}-[Pra]YCQKW[Nle]W TCDEERACCEDLRCKLWCRK II{Amide} |
| 1122 | Pra-[Nle6;Glu11,12;Val20] JzTx-V(1-29) | {H}-[Pra]YCQKW[Nle]W TCDEERACCEGLVCKLWCRK II{Amide} |
| 1123 | Pra-[Nle6;Glu11,12;Gln22] JzTx-V(1-29) | {H}-[Pra]YCQKW[Nle]W TCDEERACCEGLRCQLWCRK II{Amide} |
| 1124 | Pra-[Nle6;Glu11,12;Tyr27] JzTx-V(1-29) | {H}-[Pra]YCQKW[Nle]W TCDEERACCEGLRCKLWCRY II{Amide} |
| 1125 | Pra-[Nle6;Glu11,12;Leu27] JzTx-V(1-29) | {H}-[Pra]YCQKW[Nle]W TCDEERACCEGLRCKLWCRL II{Amide} |
| 1126 | Pra-[Nle6;Glu11,12;Val20;Gln22] JzTx-V(1-29) | {H}-[Pra]YCQKW[Nle]W TCDEERACCEGLVCQLWCRK II{Amide} |
| 1127 | Pra-[Nle6;Glu11,12;Val20;Tyr27] JzTx-V(1-29) | {H}-[Pra]YCQKW[Nle]W TCDEERACCEGLVCKLWCRY II{Amide} |
| 1128 | Pra-[Nle6;Glu11,12;Val20;Leu27] JzTx-V(1-29) | {H}-[Pra]YCQKW[Nle]W TCDEERACCEGLVCKLWCRL II{Amide} |
| 1129 | Pra-[Nle6;Glu12,18;Val20] JzTx-V(1-29) | {H}-[Pra]YCQKW[Nle]W TCDSERACCEELVCKLWCRK II{Amide} |

TABLE 5-continued

Amino acid sequences of JzTx-V and JzTx-V peptide analogs.

| SEQ ID NO. | Designation | Amino Acid Sequence |
|---|---|---|
| 1130 | Pra-[Nle6;Glu12,18;Gln22] JzTx-V(1-29) | {H}-[Pra]YCQKW[Nle]W TCDSERACCEELRCQLWCRK II{Amide} |
| 1131 | Pra-[Nle6;Glu12,18;Tyr27] JzTx-V(1-29) | {H}-[Pra]YCQKW[Nle]W TCDSERACCEELRCKLWCRY II{Amide} |
| 1132 | Pra-[Nle6;Glu12,18;Leu27] JzTx-V(1-29) | {H}-[Pra]YCQKW[Nle]W TCDSERACCEELRCKLWCRL II{Amide} |
| 1133 | Pra-[Nle6;Glu12,18;Val20;Gln22] JzTx-V(1-29) | {H}-[Pra]YCQKW[Nle]W TCDSERACCEELVCQLWCRK II{Amide} |
| 1134 | Pra-[Nle6;Glu12,18;Val20;Tyr27] JzTx-V(1-29) | {H}-[Pra]YCQKW[Nle]W TCDSERACCEELVCKLWCRY II{Amide} |
| 1135 | Pra-[Nle6;Glu12,18;Val20;Leu27] JzTx-V(1-29) | {H}-[Pra]YCQKW[Nle]W TCDSERACCEELVCKLWCRL II{Amide} |
| 1136 | CyA-[Nle6;Glu11,28;Pra17;5-BrW24] JzTx-V(1-29) | {H}-[CyA]YCQKW[Nle]W TCDEKRACC[Pra]GLRCKL [5-BrW]CRKEI{Amide} |
| 1137 | CyA-[Nle6;Glu12,28;Pra17;5-BrW24] JzTx-V(1-29) | {H}-[CyA]YCQKW[Nle]W TCDSERACC[Pra]GLRCKL [5-BrW]CRKEI{Amide} |
| 1138 | CyA-[Nle6;Glu14,28;Pra17;5-BrW24] JzTx-V(1-29) | {H}-[CyA]YCQKW[Nle]W TCDSKRECC[Pra]GLRCKL [5-BrW]CRKEI{Amide} |
| 1139 | CyA-[Nle6;Ala12;Pra17;5-BrW24;Glu28] JzTx-V(1-29) | {H}-[CyA]YCQKW[Nle]W TCDSARACC[Pra]GLRCKL [5-BrW]CRKEI{Amide} |
| 1140 | CyA-[Nle6;Pra17;Asp18;5-BrW24;Glu28] JzTx-V(1-29) | {H}-[CyA]YCQKW[Nle]W TCDSKRACC[Pra]DLRCKL [5-BrW]CRKEI{Amide} |
| 1141 | CyA-[Nle6;Pra17;Val20;5-BrW24;Glu28] JzTx-V(1-29) | {H}-[CyA]YCQKW[Nle]W TCDSKRACC[Pra]GLVCKL [5-BrW]CRKEI{Amide} |
| 1142 | CyA-[Nle6;Pra17;Gln22;5-BrW24;Glu28] JzTx-V(1-29) | {H}-[CyA]YCQKW[Nle]W TCDSKRACC[Pra]GLRCQL [5-BrW]CRKEI{Amide} |
| 1143 | CyA-[Nle6;Pra17;5-BrW24;Tyr27;Glu28] JzTx-V(1-29) | {H}-[CyA]YCQKW[Nle]W TCDSKRACC[Pra]GLRCKL [5-BrW]CRYEI{Amide} |
| 1144 | CyA-[Nle6;Pra17;5-BrW24;Leu27;Glu28] JzTx-V(1-29) | {H}-[CyA]YCQKW[Nle]W TCDSKRACC[Pra]GLRCKL [5-BrW]CRLEI{Amide} |
| 1145 | CyA-[Glu1,28;Nle6;Ala12;Pra17;5-BrW24] JzTx-V(1-29) | {H}-[CyA]ECQKW[Nle]W TCDSARACC[Pra]GLRCKL [5-BrW]CRKEI{Amide} |
| 1146 | CyA-[Glu1,28;Nle6;Pra17;Asp18;5-BrW24] JzTx-V(1-29) | {H}-[CyA]ECQKW[Nle]W TCDSKRACC[Pra]DLRCKL [5-BrW]CRKEI{Amide} |
| 1147 | CyA-[Glu1,28;Nle6;Pra17;Val20;5-BrW24] JzTx-V(1-29) | {H}-[CyA]ECQKW[Nle]W TCDSKRACC[Pra]GLVCKL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1148 | CyA-[Glu1,28;Nle6;Pra17;Gln22;5-BrW24] JzTx-V(1-29) | {H}-[CyA]ECQKW[Nle]W TCDSKRACC[Pra]GLRCQL [5-BrW]CRKEI{Amide} |
| 1149 | CyA-[Glu1,28;Nle6;Pra17;5-BrW24;Tyr27] JzTx-V(1-29) | {H}-[CyA]ECQKW[Nle]W TCDSKRACC[Pra]GLRCKL [5-BrW]CRYEI{Amide} |
| 1150 | CyA-[Glu1,28;Nle6;Pra17;5-BrW24;Leu27] JzTx-V(1-29) | {H}-[CyA]ECQKW[Nle]W TCDSKRACC[Pra]GLRCKL [5-BrW]CRLEI{Amide} |
| 1151 | CyA-[Nle6;Glu11,28;Ala12;Pra17;5-BrW24] JzTx-V(1-29) | {H}-[CyA]YCQKW[Nle]W TCDEARACC[Pra]GLRCKL [5-BrW]CRKEI{Amide} |
| 1152 | CyA-[Nle6;Glu11,28;Pra17;Asp18;5-BrW24] JzTx-V(1-29) | {H}-[CyA]YCQKW[Nle]W TCDEKRACC[Pra]DLRCKL [5-BrW]CRKEI{Amide} |
| 1153 | CyA-[Nle6;Glu11,28;Pra17;Val20;5-BrW24] JzTx-V(1-29) | {H}-[CyA]YCQKW[Nle]W TCDEKRACC[Pra]GLVCKL [5-BrW]CRKEI{Amide} |
| 1154 | CyA-[Nle6;Glu11,28;Pra17;Gln22;5-BrW24] JzTx-V(1-29) | {H}-[CyA]YCQKW[Nle]W TCDEKRACC[Pra]GLRCQL [5-BrW]CRKEI{Amide} |
| 1155 | CyA-[Nle6;Glu11,28;Pra17;5-BrW24;Tyr27] JzTx-V(1-29) | {H}-[CyA]YCQKW[Nle]W TCDEKRACC[Pra]GLRCKL [5-BrW]CRYEI{Amide} |
| 1156 | CyA-[Nle6;Glu11,28;Pra17;5-BrW24;Leu27] JzTx-V(1-29) | {H}-[CyA]YCQKW[Nle]W TCDEKRACC[Pra]GLRCKL [5-BrW]CRLEI{Amide} |
| 1157 | CyA-[Nle6;Glu12,28;Pra17;Asp18;5-BrW24] JzTx-V(1-29) | {H}-[CyA]YCQKW[Nle]W TCDSERACC[Pra]DLRCKL [5-BrW]CRKEI{Amide} |
| 1158 | CyA-[Nle6;Glu12,28;Pra17;Val20;5-BrW24] JzTx-V(1-29) | {H}-[CyA]YCQKW[Nle]W TCDSERACC[Pra]GLVCKL [5-BrW]CRKEI{Amide} |
| 1159 | CyA-[Nle6;Glu12,28;Pra17;Gln22;5-BrW24] JzTx-V(1-29) | {H}-[CyA]YCQKW[Nle]W TCDSERACC[Pra]GLRCQL [5-BrW]CRKEI{Amide} |
| 1160 | CyA-[Nle6;Glu12,28;Pra17;5-BrW24;Tyr27] JzTx-V(1-29) | {H}-[CyA]YCQKW[Nle]W TCDSERACC[Pra]GLRCKL [5-BrW]CRYEI{Amide} |
| 1161 | CyA-[Nle6;Glu12,28;Pra17;5-BrW24;Leu27] JzTx-V(1-29) | {H}-[CyA]YCQKW[Nle]W TCDSERACC[Pra]GLRCKL [5-BrW]CRLEI{Amide} |
| 1162 | CyA-[Nle6;Ala12;Glu14,28;Pra17;5-BrW24] JzTx-V(1-29) | {H}-[CyA]YCQKW[Nle]W TCDSARECC[Pra]GLRCKL [5-BrW]CRKEI{Amide} |
| 1163 | CyA-[Nle6;Glu14,28;Pra17;Asp18;5-BrW24] JzTx-V(1-29) | {H}-[CyA]YCQKW[Nle]W TCDSKRECC[Pra]DLRCKL [5-BrW]CRKEI{Amide} |
| 1164 | CyA-[Nle6;Glu14,28;Pra17;Val20;5-BrW24] JzTx-V(1-29) | {H}-[CyA]YCQKW[Nle]W TCDSKRECC[Pra]GLVCKL [5-BrW]CRKEI{Amide} |
| 1165 | CyA-[Nle6;Glu14,28;Pra17;Gln22;5-BrW24] JzTx-V(1-29) | {H}-[CyA]YCQKW[Nle]W TCDSKRECC[Pra]GLRCQL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1166 | CyA-[Nle6;Glu14,28;Pra17;5-BrW24;Tyr27] JzTx-V(1-29) | {H}-[CyA]YCQKW[Nle]W TCDSKRECC[Pra]GLRCKL [5-BrW]CRYEI{Amide} |
| 1167 | CyA-[Nle6;Glu14,28;Pra17;5-BrW24;Leu27] JzTx-V(1-29) | {H}-[CyA]YCQKW[Nle]W TCDSKRECC[Pra]GLRCKL [5-BrW]CRLEI{Amide} |
| 1168 | CyA-[Nle6;Ala12;Pra17;Val20;5-BrW24; Glu28]JzTx-V(1-29) | {H}-[CyA]YCQKW[Nle]W TCDSARACC[Pra]GLVCKL [5-BrW]CRKEI{Amide} |
| 1169 | CyA-[Nle6;Pra17;Asp18;Val20;5-BrW24; Glu28]JzTx-V(1-29) | {H}-[CyA]YCQKW[Nle]W TCDSKRACC[Pra]DLVCKL [5-BrW]CRKEI{Amide} |
| 1170 | CyA-[Nle6;Pra17;Val20;Gln22;5-BrW24; Glu28]JzTx-V(1-29) | {H}-[CyA]YCQKW[Nle]W TCDSKRACC[Pra]GLVCQL [5-BrW]CRKEI{Amide} |
| 1171 | CyA-[Nle6;Pra17;Val20;5-BrW24;Tyr27; Glu28]JzTx-V(1-29) | {H}-[CyA]YCQKW[Nle]W TCDSKRACC[Pra]GLVCKL [5-BrW]CRYEI{Amide} |
| 1172 | CyA-[Nle6;Pra17;Val20;5-BrW24;Leu27; Glu28]JzTx-V(1-29) | {H}-[CyA]YCQKW[Nle]W TCDSKRACC[Pra]GLVCKL [5-BrW]CRLEI{Amide} |
| 1173 | CyA-[Nle6;Glu11,12,28;Pra17;5-BrW24] JzTx-V(1-29) | {H}-[CyA]YCQKW[Nle]W TCDEERACC[Pra]GLRCKL [5-BrW]CRKEI{Amide} |
| 1174 | CyA-[Nle6;Glu11,12,28;Pra17;Asp18; 5-BrW24]JzTx-V(1-29) | {H}-[CyA]YCQKW[Nle]W TCDEERACC[Pra]DLRCKL [5-BrW]CRKEI{Amide} |
| 1175 | CyA-[Nle6;Glu11,12,28;Pra17;Val20; 5-BrW24]JzTx-V(1-29) | {H}-[CyA]YCQKW[Nle]W TCDEERACC[Pra]GLVCKL [5-BrW]CRKEI{Amide} |
| 1176 | CyA-[Nle6;Glu11,12,28;Pra17;Gln22; 5-BrW24]JzTx-V(1-29) | {H}-[CyA]YCQKW[Nle]W TCDEERACC[Pra]GLRCQL [5-BrW]CRKEI{Amide} |
| 1177 | CyA-[Nle6;Glu11,12,28;Pra17;5-BrW24; Tyr27]JzTx-V(1-29) | {H}-[CyA]YCQKW[Nle]W TCDEERACC[Pra]GLRCKL [5-BrW]CRYEI{Amide} |
| 1178 | CyA-[Nle6;Glu11,12,28;Pra17;5-BrW24; Leu27]JzTx-V(1-29) | {H}-[CyA]YCQKW[Nle]W TCDEERACC[Pra]GLRCKL [5-BrW]CRLEI{Amide} |
| 1179 | CyA-[Nle6;Glu11,12,28;Pra17;Val20; Gln22;5-BrW24]JzTx-V(1-29) | {H}-[CyA]YCQKW[Nle]W TCDEERACC[Pra]GLVCQL [5-BrW]CRKEI{Amide} |
| 1180 | CyA-[Nle6;Glu11,12,28;Pra17;Val20; 5-BrW24;Tyr27]JzTx-V(1-29) | {H}-[CyA]YCQKW[Nle]W TCDEERACC[Pra]GLVCKL [5-BrW]CRYEI{Amide} |
| 1181 | CyA-[Nle6;Glu11,12,28;Pra17;Val20; 5-BrW24;Leu27]JzTx-V(1-29) | {H}-[CyA]YCQKW[Nle]W TCDEERACC[Pra]GLVCKL [5-BrW]CRLEI {Amide} |
| 1182 | CyA-[Nle6;Glu12,18,28;Pra17;Val20; 5-BrW24]JzTx-V(1-29) | {H}-[CyA]YCQKW[Nle]W TCDSERACC[Pra]ELVCKL [5-BrW]CRKEI{Amide} |
| 1183 | CyA-[Nle6;Glu12,18,28;Pra17;Gln22; 5-BrW24]JzTx-V(1-29) | {H}-[CyA]YCQKW[Nle]W TCDSERACC[Pra]ELRCQL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1184 | CyA-[Nle6;Glu12,18,28;Pra17;5-BrW24; Tyr27]JzTx-V(1-29) | {H}-[CyA]YCQKW[Nle]W TCDSERACC[Pra]ELRCKL [5-BrW]CRYEI{Amide} |
| 1185 | CyA-[Nle6;Glu12,18,28;Pra17;5-BrW24; Leu27]JzTx-V(1-29) | {H}-[CyA]YCQKW[Nle]W TCDSERACC[Pra]ELRCKL [5-BrW]CRLEI{Amide} |
| 1186 | CyA-[Nle6;Glu12,18,28;Pra17;Val20; Gln22;5-BrW24]JzTx-V(1-29) | {H}-[CyA]YCQKW[Nle]W TCDSERACC[Pra]ELVCQL [5-BrW]CRKEI{Amide} |
| 1187 | CyA-[Nle6;Glu12,18,28;Pra17;Val20; 5-BrW24;Tyr27]JzTx-V(1-29) | {H}-[CyA]YCQKW[Nle]W TCDSERACC[Pra]ELVCKL [5-BrW]CRYEI{Amide} |
| 1188 | CyA-[Nle6;Glu12,18,28;Pra17;Val20; 5-BrW24;Leu27]JzTx-V(1-29) | {H}-[CyA]YCQKW[Nle]W TCDSERACC[Pra]ELVCKL [5-BrW]CRLEI{Amide} |
| 1189 | CyA-[Nle6;Pra17;5-BrW24;Tyr27;Asn28; Leu29]JzTx-V(1-29) | {H}-[CyA]YCQKW[Nle]W TCDSKRACC[Pra]GLRCKL [5-BrW]CRYNL{Amide} |
| 1190 | Pra-[Nle6;Glu11,28;5-BrW24]JzTx-V(1-29) | {H}-[Pra]YCQKW[Nle]W TCDEKRACCEGLRCKL [5-BrW]CRKEI{Amide} |
| 1191 | Pra-[Nle6;Glu12,28;5-BrW24]JzTx-V(1-29) | {H}-[Pra]YCQKW[Nle]W TCDSERACCEGLRCKL [5-BrW]CRKEI{Amide} |
| 1192 | Pra-[Nle6;Glu14,28;5-BrW24]JzTx-V(1-29) | {H}-[Pra]YCQKW[Nle]W TCDSKRECCEGLRCKL [5-BrW]CRKEI{Amide} |
| 1193 | Pra-[Nle6;Ala12;5-BrW24;Glu28] JzTx-V(1-29) | {H}-[Pra]YCQKW[Nle]W TCDSARACCEGLRCKL [5-BrW]CRKEI{Amide} |
| 1194 | Pra-[Nle6;Asp18;5-BrW24;Glu28] JzTx-V(1-29) | {H}-[Pra]YCQKW[Nle]W TCDSKRACCEDLRCKL [5-BrW]CRKEI{Amide} |
| 1195 | Pra-[Nle6;Val20;5-BrW24;Glu28] JzTx-V(1-29) | {H}-[Pra]YCQKW[Nle]W TCDSKRACCEGLVCKL [5-BrW]CRKEI{Amide} |
| 1196 | Pra-[Nle6;Gln22;5-BrW24;Glu28] JzTx-V(1-29) | {H}-[Pra]YCQKW[Nle]W TCDSKRACCEGLRCQL [5-BrW]CRKEI{Amide} |
| 1197 | Pra-[Nle6;5-BrW24;Tyr27;Glu28] JzTx-V(1-29) | {H}-[Pra]YCQKW[Nle]W TCDSKRACCEGLRCKL [5-BrW]CRYEI{Amide} |
| 1198 | Pra-[Nle6;5-BrW24;Leu27;Glu28] JzTx-V(1-29) | {H}-[Pra]YCQKW[Nle]W TCDSKRACCEGLRCKL [5-BrW]CRLEI{Amide} |
| 1199 | Pra-[Glu1,28;Nle6;Ala12;5-BrW24] JzTx-V(1-29) | {H}-[Pra]ECQKW[Nle]W TCDSARACCEGLRCKL [5-BrW]CRKEI{Amide} |
| 1200 | Pra-[Glu1,28;Nle6;Asp18;5-BrW24] JzTx-V(1-29) | {H}-[Pra]ECQKW[Nle]W TCDSKRACCEDLRCKL [5-BrW]CRKEI{Amide} |
| 1201 | Pra-[Glu1,28;Nle6;Val20;5-BrW24] JzTx-V(1-29) | {H}-[Pra]ECQKW[Nle]W TCDSKRACCEGLVCKL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1202 | Pra-[Glu1,28;Nle6;Gln22;5-BrW24] JzTx-V(1-29) | {H}-[Pra]ECQKW[Nle]W TCDSKRACCEGLRCQL [5-BrW]CRKEI{Amide} |
| 1203 | Pra-[Glu1,28;Nle6;5-BrW24;Tyr27] JzTx-V(1 -29) | {H}-[Pra]ECQKW[Nle]W TCDSKRACCEGLRCKL [5-BrW]CRYET{Amide} |
| 1204 | Pra-[Glu1,28;Nle6;5-BrW24;Leu27] JzTx-V(1-29) | {H}-[Pra]ECQKW[Nle]W TCDSKRACCEGLRCKL [5-BrW]CRLEI{Amide} |
| 1205 | Pra-[Nle6;Glu11,28;Ala12;5-BrW24] JzTx-V(1-29) | {H}-[Pra]YCQKW[Nle]W TCDEARACCEGLRCKL [5-BrW]CRKEI{Amide} |
| 1206 | Pra-[Nle6;Glu11,28;Asp18;5-BrW24] JzTx-V(1-29) | {H}-[Pra]YCQKW[Nle]W TCDEKRACCEDLRCKL [5-BrW]CRKEI{Amide} |
| 1207 | Pra-[Nle6;Glu11,28;Val20;5-BrW24] JzTx-V(1-29) | {H}-[Pra]YCQKW[Nle]W TCDEKRACCEGLVCKL [5-BrW]CRKEI{Amide} |
| 1208 | Pra-[Nle6;Glu11,28;Gln22;5-BrW24] JzTx-V(1-29) | {H}-[Pra]YCQKW[Nle]W TCDEKRACCEGLRCQL [5-BrW]CRKEI{Amide} |
| 1209 | Pra-[Nle6;Glu11,28;5-BrW24;Tyr27] JzTx-V(1-29) | {H}-[Pra]YCQKW[Nle]W TCDEKRACCEGLRCKL [5-BrW]CRYET{Amide} |
| 1210 | Pra-[Nle6;Glu11,28;5-BrW24;Leu27] JzTx-V(1-29) | {H}-[Pra]YCQKW[Nle]W TCDEKRACCEGLRCKL [5-BrW]CRLEI{Amide} |
| 1211 | Pra-[Nle6;Glu12,28;Asp18;5-BrW24] JzTx-V(1-29) | {H}-[Pra]YCQKW[Nle]W TCDSERACCEDLRCKL [5-BrW]CRKEI{Amide} |
| 1212 | Pra-[Nle6;Glu12,28;Val20;5-BrW24] JzTx-V(1-29) | {H}-[Pra]YCQKW[Nle]W TCDSERACCEGLVCKL [5-BrW]CRKEI{Amide} |
| 1213 | Pra-[Nle6;Glu12,28;Gln22;5-BrW24] JzTx-V(1-29) | {H}-[Pra]YCQKW[Nle]W TCDSERACCEGLRCQL [5-BrW]CRKEI{Amide} |
| 1214 | Pra-[Nle6;Glu12,28;5-BrW24;Tyr27] JzTx-V(1-29) | {H}-[Pra]YCQKW[Nle]W TCDSERACCEGLRCKL [5-BrW]CRYET{Amide} |
| 1215 | Pra-[Nle6;Glu12,28;5-BrW24;Leu27] JzTx-V(1-29) | {H}-[Pra]YCQKW[Nle]W TCDSERACCEGLRCKL [5-BrW]CRLEI{Amide} |
| 1216 | Pra-[Nle6;Ala12;Glu13,28;5-BrW24] JzTx-V(1-29) | {H}-[Pra]YCQKW[Nle]W TCDSAEACCEGLRCKL [5-BrW]CRKEI{Amide} |
| 1217 | Pra-[Nle6;Glu13,28;Asp18;5-BrW24] JzTx-V(1-29) | {H}-[Pra]YCQKW[Nle]W TCDSKEACCEDLRCKL [5-BrW]CRKEI{Amide} |
| 1218 | Pra-[Nle6;Glu13,28;Val20;5-BrW24] JzTx-V(1-29) | {H}-[Pra]YCQKW[Nle]W TCDSKEACCEGLVCKL [5-BrW]CRKEI{Amide} |
| 1219 | Pra-[Nle6;Glu13,28;Gln22;5-BrW24] JzTx-V(1-29) | {H}-[Pra]YCQKW[Nle]W TCDSKEACCEGLRCQL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1220 | Pra-[Nle6;Glu13,28;5-BrW24;Tyr27] JzTx-V(1-29) | {H}-[Pra]YCQKW[Nle]W TCDSKEACCEGLRCKL [5-BrW]CRYEI{Amide} |
| 1221 | Pra-[Nle6;Glu13,28;5-BrW24;Leu27] JzTx-V(1-29) | {H}-[Pra]YCQKW[Nle]W TCDSKEACCEGLRCKL [5-BrW]CRLEI{Amide} |
| 1222 | Pra-[Nle6;Ala12;Val20;5-BrW24;Glu28] JzTx-V(1-29) | {H}-[Pra]YCQKW[Nle]W TCDSARACCEGLVCKL [5-BrW]CRKEI{Amide} |
| 1223 | Pra-[Nle6;Asp18;Val20;5-BrW24;Glu28] JzTx-V(1-29) | {H}-[Pra]YCQKW[Nle]W TCDSKRACCEDLVCKL [5-BrW]CRKEI{Amide} |
| 1224 | Pra-[Nle6;Val20;Gln22;5-BrW24;Glu28] JzTx-V(1-29) | {H}-[Pra]YCQKW[Nle]W TCDSKRACCEGLVCQL [5-BrW]CRKEI{Amide} |
| 1225 | Pra-[Nle6;Val20;5-BrW24;Tyr27;Glu28] JzTx-V(1-29) | {H}-[Pra]YCQKW[Nle]W TCDSKRACCEGLVCKL [5-BrW]CRYEI{Amide} |
| 1226 | Pra-[Nle6;Val20;5-BrW24;Leu27;Glu28] JzTx-V(1-29) | {H}-[Pra]YCQKW[Nle]W TCDSKRACCEGLVCKL [5-BrW]CRLEI{Amide} |
| 1227 | Pra-[Nle6;Glu11,12,28;5-BrW24] JzTx-V(1-29) | {H}-[Pra]YCQKW[Nle]W TCDEERACCEGLRCKL [5-BrW]CRKEI{Amide} |
| 1228 | Pra-[Nle6;Glu11,12,28;Asp18;5-BrW24] JzTx-V(1-29) | {H}-[Pra]YCQKW[Nle]W TCDEERACCEDLRCKL [5-BrW]CRKEI{Amide} |
| 1229 | Pra-[Nle6;Glu11,12,28;Val20;5-BrW24] JzTx-V(1-29) | {H}-[Pra]YCQKW[Nle]W TCDEERACCEGLVCKL [5-BrW]CRKEI{Amide} |
| 1230 | Pra-[Nle6;Glu11,12,28;Gln22;5-BrW24] JzTx-V(1-29) | {H}-[Pra]YCQKW[Nle]W TCDEERACCEGLRCQL [5-BrW]CRKEI{Amide} |
| 1231 | Pra-[Nle6;Glu11,12,28;5-BrW24;Tyr27] JzTx-V(1-29) | {H}-[Pra]YCQKW[Nle]W TCDEERACCEGLRCKL [5-BrW]CRYEI{Amide} |
| 1232 | Pra-[Nle6;Glu11,12,28;5-BrW24;Leu27] JzTx-V(1-29) | {H}-[Pra]YCQKW[Nle]W TCDEERACCEGLRCKL [5-BrW]CRLEI{Amide} |
| 1233 | Pra-[Nle6;Glu11,12,28;Val20;Gln22; 5-BrW24]JzTx-V(1-29) | {H}-[Pra]YCQKW[Nle]W TCDEERACCEGLVCQL [5-BrW]CRKEI{Amide} |
| 1234 | Pra-[Nle6;Glu11,12,28;Val20;5-BrW24; Tyr27]JzTx-V(1-29) | {H}-[Pra]YCQKW[Nle]W TCDEERACCEGLVCKL [5-BrW]CRYEI{Amide} |
| 1235 | Pra-[Nle6;Glu11,12,28;Val20;5-BrW24; Leu27]JzTx-V(1-29) | {H}-[Pra]YCQKW[Nle]W TCDEERACCEGLVCKL [5-BrW]CRLEI{Amide} |
| 1236 | Pra-[Nle6;Glu12,18,28;Val20;5-BrW24] JzTx-V(1-29) | {H}-[Pra]YCQKW[Nle]W TCDSERACCEELVCKL [5-BrW]CRKEI{Amide} |
| 1237 | Pra-[Nle6;Glu12,18,28;Gln22;5-BrW24] JzTx-V(1-29) | {H}-[Pra]YCQKW[Nle]W TCDSERACCEELRCQL [5-BrW]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1238 | Pra-[Nle6;Glu12,18,28;5-BrW24;Tyr27] JzTx-V(1-29) | {H}-[Pra]YCQKW[Nle]W TCDSERACCEELRCKL [5-BrW]CRYEI{Amide} |
| 1239 | Pra-[Nle6;Glu12,18,28;5-BrW24;Leu27] JzTx-V(1-29) | {H}-[Pra]YCQKW[Nle]W TCDSERACCEELRCKL [5-BrW]CRLEI{Amide} |
| 1240 | Pra-[Nle6;Glu12,18,28;Val20;Gln22; 5-BrW24]JzTx-V(1-29) | {H}-[Pra]YCQKW[Nle]W TCDSERACCEELVCQL [5-BrW]CRKEI{Amide} |
| 1241 | Pra-[Nle6;Glu12,18,28;Val20;5-BrW24; Tyr27]JzTx-V(1-29) | {H}-[Pra]YCQKW[Nle]W TCDSERACCEELVCKL [5-BrW]CRYEI{Amide} |
| 1242 | Pra-[Nle6;Glu12,18,28;Val20;5-BrW24; Leu27]JzTx-V(1 -29) | {H}-[Pra]YCQKW[Nle]W TCDSERACCEELVCKL [5-BrW]CRLEI{Amide} |
| 1243 | Pra-[Nle6;5-BrW24;Tyr27;Asn28;Leu29] JzTx-V(1-29) | {H}-[Pra]YCQKW[Nle]W TCDSKRACCEGLRCKL [5-BrW]CRYNL{Amide} |
| 1244 | CyA-[Nle6;Glu11;Pra17;5-BrW24] JzTx-V(1-29) | {H}-[CyA]YCQKW[Nle]W TCDEKRACC[Pra]GLRCKL [5-BrW]CRKII{Amide} |
| 1245 | CyA-[Nle6;Glu12;Pra17;5-BrW24] JzTx-V(1-29) | {H}-[CyA]YCQKW[Nle]W TCDSERACC[Pra]GLRCKL [5-BrW]CRKII{Amide} |
| 1246 | CyA-[Nle6;Glu14;Pra17;5-BrW24] JzTx-V(1-29) | {H}-[CyA]YCQKW[Nle]W TCDSKRECC[Pra]GLRCKL [5-BrW]CRKII{Amide} |
| 1247 | CyA-[Nle6;Ala12;Pra17;5-BrW24] JzTx-V(1-29) | {H}-[CyA]YCQKW[Nle]W TCDSARACC[Pra]GLRCKL [5-BrW]CRKII{Amide} |
| 1248 | CyA-[Nle6;Pra17;Asp18;5-BrW24] JzTx-V(1-29) | {H}-[CyA]YCQKW[Nle]W TCDSKRACC[Pra]DLRCKL [5-BrW]CRKII{Amide} |
| 1249 | CyA-[Nle6;Pra17;Val20;5-BrW24] JzTx-V(1-29) | {H}-[CyA]YCQKW[Nle]W TCDSKRACC[Pra]GLVCKL [5-BrW]CRKII{Amide} |
| 1250 | CyA-[Nle6;Pra17;Gln22;5-BrW24] JzTx-V(1-29) | {H}-[CyA]YCQKW[Nle]W TCDSKRACC[Pra]GLRCQL [5-BrW]CRKII{Amide} |
| 1251 | CyA-[Nle6;Pra17;5-BrW24;Tyr27] JzTx-V(1-29) | {H}-[CyA]YCQKW[Nle]W TCDSKRACC[Pra]GLRCKL [5-BrW]CRYII{Amide} |
| 1252 | CyA-[Nle6;Pra17;5-BrW24;Leu27] JzTx-V(1-29) | {H}-[CyA]YCQKW[Nle]W TCDSKRACC[Pra]GLRCKL [5-BrW]CRLII{Amide} |
| 1253 | CyA-[Glu1;Nle6;Ala12;Pra17; 5-BrW24]JzTx-V(1-29) | {H}-[CyA]ECQKW[Nle]W TCDSARACC[Pra]GLRCKL [5-BrW]CRKII{Amide} |
| 1254 | CyA-[Glu1;Nle6;Pra17;Asp18; 5-BrW24]JzTx-V(1-29) | {H}-[CyA]ECQKW[Nle]W TCDSKRACC[Pra]DLRCKL [5-BrW]CRKII{Amide} |
| 1255 | CyA-[Glu1;Nle6;Pra17;Val20;5-BrW24] JzTx-V(1-29) | {H}-[CyA]ECQKW[Nle]W TCDSKRACC[Pra]GLVCKL [5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 1256 | CyA-[Glu1;Nle6;Pra17;Gln22;5-BrW24] JzTx-V(1-29) | {H}-[CyA]ECQKW[Nle]W TCDSKRACC[Pra]GLRCQL [5-BrW]CRKII{Amide} |
| 1257 | CyA-[Glu1;Nle6;Pra17;5-BrW24;Tyr27] JzTx-V(1-29) | {H}-[CyA]ECQKW[Nle]W TCDSKRACC[Pra]GLRCKL [5-BrW]CRYII{Amide} |
| 1258 | CyA-[Glu1;Nle6;Pra17;5-BrW24;Leu27] JzTx-V(1-29) | {H}-[CyA]ECQKW[Nle]W TCDSKRACC[Pra]GLRCKL [5-BrW]CRLII{Amide} |
| 1259 | CyA-[Nle6;Glu11;Ala12;Pra17; 5-BrW24]JzTx-V(1-29) | {H}-[CyA]YCQKW[Nle]W TCDEARACC[Pra]GLRCKL [5-BrW]CRKII{Amide} |
| 1260 | CyA-[Nle6;Glu11;Pra17;Asp18; 5-BrW24]JzTx-V(1-29) | {H}-[CyA]YCQKW[Nle]W TCDEKRACC[Pra]DLRCKL [5-BrW]CRKII{Amide} |
| 1261 | CyA-[Nle6;Glu11;Pra17;Val20; 5-BrW24]JzTx-V(1-29) | {H}-[CyA]YCQKW[Nle]W TCDEKRACC[Pra]GLVCKL [5-BrW]CRKII{Amide} |
| 1262 | CyA-[Nle6;Glu11;Pra17;Gln22; 5-BrW24]JzTx-V(1-29) | {H}-[CyA]YCQKW[Nle]W TCDEKRACC[Pra]GLRCQL [5-BrW]CRKII{Amide} |
| 1263 | CyA-[Nle6;Glu11;Pra17;5-BrW24; Tyr27]JzTx-V(1-29) | {H}-[CyA]YCQKW[Nle]W TCDEKRACC[Pra]GLRCKL [5-BrW]CRYII{Amide} |
| 1264 | CyA-[Nle6;Glu11;Pra17;5-BrW24; Leu27]JzTx-V(1-29) | {H}-[CyA]YCQKW[Nle]W TCDEKRACC[Pra]GLRCKL [5-BrW]CRLII{Amide} |
| 1265 | CyA-[Nle6;Glu12;Pra17;Asp18; 5-BrW24]JzTx-V(1-29) | {H}-[CyA]YCQKW[Nle]W TCDSERACC[Pra]DLRCKL [5-BrW]CRKII{Amide} |
| 1266 | CyA-[Nle6;Glu12;Pra17;Val20; 5-BrW24]JzTx-V(1-29) | {H}-[CyA]YCQKW[Nle]W TCDSERACC[Pra]GLVCKL [5-BrW]CRKII{Amide} |
| 1267 | CyA-[Nle6;Glu12;Pra17;Gln22; 5-BrW24]JzTx-V(1-29) | {H}-[CyA]YCQKW[Nle]W TCDSERACC[Pra]GLRCQL [5-BrW]CRKII{Amide} |
| 1268 | CyA-[Nle6;Glu12;Pra17;5-BrW24; Tyr27]JzTx-V(1-29) | {H}-[CyA]YCQKW[Nle]W TCDSERACC[Pra]GLRCKL [5-BrW]CRYII{Amide} |
| 1269 | CyA-[Nle6;Glu12;Pra17;5-BrW24; Leu27]JzTx-V(1-29) | {H}-[CyA]YCQKW[Nle]W TCDSERACC[Pra]GLRCKL [5-BrW]CRLII{Amide} |
| 1270 | CyA-[Nle6;Ala12;Glu14;Pra17; 5-BrW24]JzTx-V(1-29) | {H}-[CyA]YCQKW[Nle]W TCDSARECC[Pra]GLRCKL [5-BrW]CRKII{Amide} |
| 1271 | CyA-[Nle6;Glu14;Pra17;Asp18; 5-BrW24]JzTx-V(1-29) | {H}-[CyA]YCQKW[Nle]W TCDSKRECC[Pra]DLRCKL [5-BrW]CRKII{Amide} |
| 1272 | CyA-[Nle6;Glu14;Pra17;Val20; 5-BrW24]JzTx-V(1-29) | {H}-[CyA]YCQKW[Nle]W TCDSKRECC[Pra]GLVCKL [5-BrW]CRKII{Amide} |
| 1273 | CyA-[Nle6;Glu14;Pra17;Gln22; 5-BrW24]JzTx-V(1-29) | {H}-[CyA]YCQKW[Nle]W TCDSKRECC[Pra]GLRCQL [5-BrW]CRKII{Amide} |

TABLE 5-continued

| Amino acid sequences of JzTx-V and JzTx-V peptide analogs. | | |
|---|---|---|
| SEQ ID NO. | Designation | Amino Acid Sequence |
| 1274 | CyA-[Nle6;Glu14;Pra17;5-BrW24; Tyr27]JzTx-V(1-29) | {H}-[CyA]YCQKW[Nle]W TCDSKRECC[Pra]GLRCKL [5-BrW]CRYII{Amide} |
| 1275 | CyA-[Nle6;Glu14;Pra17;5-BrW24; Leu27]JzTx-V(1-29) | {H}-[CyA]YCQKW[Nle]W TCDSKRECC[Pra]GLRCKL [5-BrW]CRLII{Amide} |
| 1276 | CyA-[Nle6;Ala12;Pra17;Val20; 5-BrW24]JzTx-V(1-29) | {H}-[CyA]YCQKW[Nle]W TCDSARACC[Pra]GLVCKL [5-BrW]CRKII{Amide} |
| 1277 | CyA-[Nle6;Pra17;Asp18;Val20; 5-BrW24]JzTx-V(1-29) | {H}-[CyA]YCQKW[Nle]W TCDSKRACC[Pra]DLVCKL [5-BrW]CRKII{Amide} |
| 1278 | CyA-[Nle6;Pra17;Val20;Gln22; 5-BrW24]JzTx-V(1-29) | {H}-[CyA]YCQKW[Nle]W TCDSKRACC[Pra]GLVCQL [5-BrW]CRKII{Amide} |
| 1279 | CyA-[Nle6;Pra17;Val20;5-BrW24; Tyr27]JzTx-V(1-29) | {H}-[CyA]YCQKW[Nle]W TCDSKRACC[Pra]GLVCKL [5-BrW]CRYII{Amide} |
| 1280 | CyA-[Nle6;Pra17;Val20;5-BrW24; Leu27]JzTx-V(1-29) | {H}-[CyA]YCQKW[Nle]W TCDSKRACC[Pra]GLVCKL [5-BrW]CRLII{Amide} |
| 1281 | CyA-[Nle6;Glu11,12;Pra17; 5-BrW24]JzTx-V(1-29) | {H}-[CyA]YCQKW[Nle]W TCDEERACC[Pra]GLRCKL [5-BrW]CRKII{Amide} |
| 1282 | CyA-[Nle6;Glu11,12;Pra17;Asp18; 5-BrW24]JzTx-V(1-29) | {H}-[CyA]YCQKW[Nle]W TCDEERACC[Pra]DLRCKL [5-BrW]CRKII{Amide} |
| 1283 | CyA-[Nle6;Glu11,12;Pra17;Val20; 5-BrW24]JzTx-V(1-29) | {H}-[CyA]YCQKW[Nle]W TCDEERACC[Pra]GLVCKL [5-BrW]CRKII{Amide} |
| 1284 | CyA-[Nle6;Glu11,12;Pra17;Gln22; 5-BrW24]JzTx-V(1-29) | {H}-[CyA]YCQKW[Nle]W TCDEERACC[Pra]GLRCQL [5-BrW]CRKII{Amide} |
| 1285 | CyA-[Nle6;Glu11,12;Pra17;5-BrW24; Tyr27]JzTx-V(1-29) | {H}-[CyA]YCQKW[Nle]W TCDEERACC[Pra]GLRCKL [5-BrW]CRYII{Amide} |
| 1286 | CyA-[Nle6;Glu11,12;Pra17;5-BrW24; Leu27]JzTx-V(1-29) | {H}-[CyA]YCQKW[Nle]W TCDEERACC[Pra]GLRCKL [5-BrW]CRLII{Amide} |
| 1287 | CyA-[Nle6;Glu11,12;Pra17;Val20; Gln22;5-BrW24]JzTx-V(1-29) | {H}-[CyA]YCQKW[Nle]W TCDEERACC[Pra]GLVCQL [5-BrW]CRKII{Amide} |
| 1288 | CyA-[Nle6;Glu11,12;Pra17;Val20; 5-BrW24;Tyr27]JzTx-V(1-29) | {H}-[CyA]YCQKW[Nle]W TCDEERACC[Pra]GLVCKL [5-BrW]CRYII{Amide} |
| 1289 | CyA-[Nle6;Glu11,12;Pra17;Val20; 5-BrW24;Leu27]JzTx-V(1-29) | {H}-[CyA]YCQKW[Nle]W TCDEERACC[Pra]GLVCKL [5-BrW]CRLII{Amide} |
| 1290 | CyA-[Nle6;Glu12,18;Pra17;Val20; 5-BrW24]JzTx-V(1-29) | {H}-[CyA]YCQKW[Nle]W TCDSERACC[Pra]ELVCKL [5-BrW]CRKII{Amide} |
| 1291 | CyA-[Nle6;Glu12,18;Pra17;Gln22; 5-BrW24]JzTx-V(1-29) | {H}-[CyA]YCQKW[Nle]W TCDSERACC[Pra]ELRCQL [5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 1292 | CyA-[Nle6;Glu12,18;Pra17;5-BrW24; Tyr27]JzTx-V(1 -29) | {H}-[CyA]YCQKW[Nle]W TCDSERACC[Pra]ELRCKL [5-BrW]CRYII{Amide} |
| 1293 | CyA-[Nle6;Glu12,18;Pra17;5-BrW24; Leu27]JzTx-V(1 -29) | {H}-[CyA]YCQKW[Nle]W TCDSERACC[Pra]ELRCKL [5-BrW]CRLII{Amide} |
| 1294 | CyA-[Nle6;Glu12,18;Pra17;Val20; Gln22;5-BrW24]JzTx-V(1-29) | {H}-[CyA]YCQKW[Nle]W TCDSERACC[Pra]ELVCQL [5-BrW]CRKII{Amide} |
| 1295 | CyA-[Nle6;Glu12,18;Pra17;Val20; 5-BrW24;Tyr27]JzTx-V(1-29) | {H}-[CyA]YCQKW[Nle]W TCDSERACC[Pra]ELVCKL [5-BrW]CRYII{Amide} |
| 1296 | CyA-[Nle6;Glu12,18;Pra17;Val20; 5-BrW24;Leu27]JzTx-V(1-29) | {H}-[CyA]YCQKW[Nle]W TCDSERACC[Pra]ELVCKL [5-BrW]CRLII{Amide} |
| 1297 | Pra-[Nle6;Glu11;5-BrW24]JzTx-V(1-29) | {H}-[Pra]YCQKW[Nle]W TCDEKRACCEGLRCKL [5-BrW]CRKII{Amide} |
| 1298 | Pra-[Nle6;Glu12;5-BrW24]JzTx-V(1-29) | {H}-[Pra]YCQKW[Nle]W TCDSERACCEGLRCKL [5-BrW]CRKII{Amide} |
| 1299 | Pra-[Nle6;Glu14;5-BrW24]JzTx-V(1-29) | {H}-[Pra]YCQKW[Nle]W TCDSKRECCEGLRCKL [5-BrW]CRKII{Amide} |
| 1300 | Pra-[Nle6;Ala12;5-BrW24]JzTx-V(1-29) | {H}-[Pra]YCQKW[Nle]W TCDSARACCEGLRCKL [5-BrW]CRKII{Amide} |
| 1301 | Pra-[Nle6;Asp18;5-BrW24]JzTx-V(1-29) | {H}-[Pra]YCQKW[Nle]W TCDSKRACCEDLRCKL [5-BrW]CRKII{Amide} |
| 1302 | Pra-[Nle6;Val20;5-BrW24]JzTx-V(1-29) | {H}-[Pra]YCQKW[Nle]W TCDSKRACCEGLVCKL [5-BrW]CRKII{Amide} |
| 1303 | Pra-[Nle6;Gln22;5-BrW24]JzTx-V(1-29) | {H}-[Pra]YCQKW[Nle]W TCDSKRACCEGLRCQL [5-BrW]CRKII{Amide} |
| 1304 | Pra-[Nle6;5-BrW24;Tyr27]JzTx-V(1-29) | {H}-[Pra]YCQKW[Nle]W TCDSKRACCEGLRCKL [5-BrW]CRYII{Amide} |
| 1305 | Pra-[Nle6;5-BrW24;Leu27]JzTx-V(1-29) | {H}-[Pra]YCQKW[Nle]W TCDSKRACCEGLRCKL [5-BrW]CRLII{Amide} |
| 1306 | Pra-[Glu1;Nle6;Ala12;5-BrW24] JzTx-V(1-29) | {H}-[Pra]ECQKW[Nle]W TCDSARACCEGLRCKL [5-BrW]CRKII{Amide} |
| 1307 | Pra-[Glu1;Nle6;Asp18;5-BrW24] JzTx-V(1-29) | {H}-[Pra]ECQKW[Nle]W TCDSKRACCEDLRCKL [5-BrW]CRKII{Amide} |
| 1308 | Pra-[Glu1;Nle6;Val20;5-BrW24] JzTx-V(1-29) | {H}-[Pra]ECQKW[Nle]W TCDSKRACCEGLVCKL [5-BrW]CRKII{Amide} |
| 1309 | Pra-[Glu1;Nle6;Gln22;5-BrW24] JzTx-V(1-29) | {H}-[Pra]ECQKW[Nle]W TCDSKRACCEGLRCQL [5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 1310 | Pra-[Glu1;Nle6;5-BrW24;Tyr27] JzTx-V(1 -29) | {H}-[Pra]ECQKW[Nle]W TCDSKRACCEGLRCKL [5-BrW]CRYII{Amide} |
| 1311 | Pra-[Glu1;Nle6;5-BrW24;Leu27] JzTx-V(1 -29) | {H}-[Pra]ECQKW[Nle]W TCDSKRACCEGLRCKL [5-BrW]CRLII{Amide} |
| 1312 | Pra-[Nle6;Glu11;Ala12;5-BrW24] JzTx-V(1-29) | {H}-[Pra]YCQKW[Nle]W TCDEARACCEGLRCKL [5-BrW]CRKII{Amide} |
| 1313 | Pra-[Nle6;Glu11;Asp18;5-BrW24] JzTx-V(1-29) | {H}-[Pra]YCQKW[Nle]W TCDEKRACCEDLRCKL [5-BrW]CRKII{Amide} |
| 1314 | Pra-[Nle6;Hlu11;Val20;5-BrW24] JzTx-V(1-29) | {H}-[Pra]YCQKW[Nle]W TCDEKRACCEGLVCKL [5-BrW]CRKII{Amide} |
| 1315 | Pra-[Nle6;Glu11;Gln22;5-BrW24] JzTx-V(1-29) | {H}-[Pra]YCQKW[Nle]W TCDEKRACCEGLRCQL [5-BrW]CRKII{Amide} |
| 1316 | Pra-[Nle6;Glu11;5-BrW24;Tyr27] JzTx-V(1-29) | {H}-[Pra]YWCQKW[Nle]W TCDEKRACCEGLRCKL [5-BrW]CRYII{Amide} |
| 1317 | Pra-[Nle6;Glu11;5-BrW24;Leu27] JzTx-V(1-29) | {H}-[Pra]YCQKW[Nle]W TCDEKRACCEGLRCKL [5-BrW]CRLII{Amide} |
| 1318 | Pra-[Nle6;Glu12;Asp18;5-BrW24] JzTx-V(1-29) | {H}-[Pra]YCQKW[Nle]W TCDSERACCEDLRCKL [5-BrW]CRKII{Amide} |
| 1319 | Pra-[Nle6;Glu12;Val20;5-BrW24] JzTx-V(1-29) | {H}-[Pra]YCQKW[Nle]W TCDSERACCEGLVCKL [5-BrW]CRKII{Amide} |
| 1320 | Pra-[Nle6;Glu12;Gln22;5-BrW24] JzTx-V(1-29) | {H}-[Pra]YCQKW[Nle]W TCDSERACCEGLRCQL [5-BrW]CRKII{Amide} |
| 1321 | Pra-[Nle6;Glu12;5-BrW24;Tyr27] JzTx-V(1-29) | {H}-[Pra]YCQKW[Nle]W TCDSERACCEGLRCKL [5-BrW]CRYII{Amide} |
| 1322 | Pra-[Nle6;Glu12;5-BrW24;Leu27] JzTx-V(1-29) | {H}-[Pra]YCQKW[Nle]W TCDSERACCEGLRCKL [5-BrW]CRLII{Amide} |
| 1323 | Pra-[Nle6;Ala12;Glu13;5-BrW24] JzTx-V(1-29) | {H}-[Pra]YCQKW[Nle]W TCDSAEACCEGLRCKL [5-BrW]CRKII{Amide} |
| 1324 | Pra-[Nle6;Glu13;Asp18;5-BrW24] JzTx-V(1-29) | {H}-[Pra]YCQKW[Nle]W TCDSKEACCEDLRCKL [5-BrW]CRKII{Amide} |
| 1325 | Pra-]Nle6;Glu13;Val20;5-BrW24] JzTx-V(1-29) | {H}-[Pra]YCQKW[Nle]W TCDSKEACCEGLVCKL [5-BrW]CRKII{Amide} |
| 1326 | Pra-[Nle6;Glu13;Gln22;5-BrW24] JzTx-V(1-29) | {H}-[Pra]YCQKW[Nle]W TCDSKEACCEGLRCQL [5-BrW]CRKII{Amide} |
| 1327 | Pra-[Nle6;Glu13;5-BrW24;Tyr27] JzTx-V(1-29) | {H}-[Pra]YCQKW[Nle]W TCDSKEACCEGLRCKL [5-BrW]CRYII{Amide} |

TABLE 5-continued

Amino acid sequences of JzTx-V and JzTx-V peptide analogs.

| SEQ ID NO. | Designation | Amino Acid Sequence |
|---|---|---|
| 1328 | Pra-[Nle6;Glu13;5-BrW24;Leu27] JzTx-V(1-29) | {H}-[Pra]YCQKW[Nle]W TCDSKEACCEGLRCKL [5-BrW]CRLII{Amide} |
| 1329 | Pra-[Nle6;Ala12;Val20;5-BrW24] JzTx-V(1-29) | {H}-[Pra]YCQKW[Nle]W TCDSARACCEGLVCKL [5-BrW]CRKII{Amide} |
| 1330 | Pra-[Nle6;Asp18;Val20;5-BrW24] JzTx-V(1-29) | {H}-[Pra]YCQKW[Nle]W TCDSKRACCEDLVCKL [5-BrW]CRKII{Amide} |
| 1331 | Pra-[Nle6;Val20;Gln22;5-BrW24] JzTx-V(1-29) | {H}-[Pra]YCQKW[Nle]W TCDSKRACCEGLVCQL [5-BrW]CRKII{Amide} |
| 1332 | Pra-[Nle6;Val20;5-BrW24;Tyr27] JzTx-V(1-29) | {H}-[Pra]YCQKW[Nle]W TCDSKRACCEGLVCKL [5-BrW]CRYII{Amide} |
| 1333 | Pra-[Nle6;Val20;5-BrW24;Leu27] JzTx-V(1-29) | {H}-[Pra]YCQKW[Nle]W TCDSKRACCEGLVCKL [5-BrW]CRLII{Amide} |
| 1334 | Pra-[Nle6;Glu11,12;5-BrW24] JzTx-V(1-29) | {H}-[Pra]YCQKW[Nle]W TCDEERACCEGLRCKL [5-BrW]CRKII{Amide} |
| 1335 | Pra-[Nle6;Glu11,12;Asp18;5-BrW24] JzTx-V(1-29) | {H}-[Pra]YCQKW[Nle]W TCDEERACCEDLRCKL [5-BrW]CRKII{Amide} |
| 1336 | Pra-[Nle6;Glu11,12;Val20;5-BrW24] JzTx-V(1-29) | {H}-[Pra]YCQKW[Nle]W TCDEERACCEGLVCKL [5-BrW]CRKII{Amide} |
| 1337 | Pra-[Nle6;Glu11,12;Gln22;5-BrW24] JzTx-V(1-29) | {H}-[Pra]YCQKW[Nle]W TCDEERACCEGLRCQL [5-BrW]CRKII{Amide} |
| 1338 | Pra-[Nle6;Glu11,12;5-BrW24;Tyr27] JzTx-V(1 -29) | {H}-[Pra]YCQKW[Nle]W TCDEERACCEGLRCKL [5-BrW]CRYII{Amide} |
| 1339 | Pra-[Nle6;Glu11,12;5-BrW24;Leu27] JzTx-V(1-29) | {H}-[Pra]YCQKW[Nle]W TCDEERACCEGLRCKL [5-BrW]CRLII{Amide} |
| 1340 | Pra-[Nle6;Glu11,12;Val20;Gln22; 5-BrW24]JzTx-V(1-29) | {H}-[Pra]YCQKW[Nle]W TCDEERACCEGLVCQL [5-BrW]CRKII{Amide} |
| 1341 | Pra-[Nle6;Glu11,12;Val20;5-BrW24; Tyr27]JzTx-V(1-29) | {H}-[Pra]YCQKW[Nle]W TCDEERACCEGLVCKL [5-BrW]CRYII{Amide} |
| 1342 | Pra-[Nle6;Glu11,12;Val20;5-BrW24; Leu27]JzTx-V(1 -29) | {H}-[Pra]YCQKW[Nle]W TCDEERACCEGLVCKL [5-BrW]CRLII{Amide} |
| 1343 | Pra-[Nle6;Glu12,18;Val20;5-BrW24] JzTx-V(1-29) | {H}-[Pra]YCQKW[Nle]W TCDSERACCEELVCKL [5-BrW]CRKII{Amide} |
| 1344 | Pra-[Nle6;Glu12,18;Gln22;5-BrW24] JzTx-V(1-29) | {H}-[Pra]YCQKW[Nle]W TCDSERACCEELRCQL [5-BrW]CRKII{Amide} |
| 1345 | Pra-[Nle6;Glu12,18;5-BrW24;Tyr27] JzTx-V(1 -29) | {H}-[Pra]YCQKW[Nle]W TCDSERACCEELRCKL [5-BrW]CRYII{Amide} |

TABLE 5-continued

Amino acid sequences of JzTx-V and JzTx-V peptide analogs.

| SEQ ID NO. | Designation | Amino Acid Sequence |
|---|---|---|
| 1346 | Pra-[Nle6;Glu12,18;5-BrW24;Leu27] JzTx-V(1-29) | {H}-[Pra]YCQKW[Nle]W TCDSERACCEELRCKL [5-BrW]CRLII{Amide} |
| 1347 | Pra-[Nle6;Glu12,18;Val20;Gln22; 5-BrW24]JzTx-V(1 -29) | {H}-[Pra]YCQKW[Nle]W TCDSERACCEELVCQL [5-BrW]CRKII{Amide} |
| 1348 | Pra-[Nle6;Glu12,18;Val20;5-BrW24; Tyr27]JzTx-V(1-29) | {H}-[Pra]YCQKW[Nle]W TCDSERACCEELVCKL [5-BrW]CRYII{Amide} |
| 1349 | Pra-[Nle6;Glu12,18;Val20;5-BrW24; Leu27]JzTx-V(1 -29) | {H}-[Pra]YCQKW[Nle]W TCDSERACCEELVCKL [5-BrW]CRLII{Amide} |
| 1350 | CyA-[Glu1,28;Nle6;Pra17;5-BrW24] JzTx-V(1-29) | {H}-[CyA]ECQKW[Nle]W TCDSKRACC[Pra]GLRCKL [5-BrW]CRKEI{Amide} |
| 1351 | CyA-[Nle6;Glu12,18,28;Pra17; 5-BrW24]JzTx-V(1-29) | {H}-[CyA]YCQKW[Nle]W TCDSERACC[Pra]ELRCKL [5-BrW]CRKEI{Amide} |
| 1352 | Pra-[Glu1,28;Nle6;5-BrW24] JzTx-V(1-29) | {H}-[Pra]ECQKW[Nle]W TCDSKRACCEGLRCKL [5-BrW]CRKEI{Amide} |
| 1353 | Pra-[Nle6;Glu12,18,28;5-BrW24] JzTx-V(1-29) | {H}-[Pra]YCQKW[Nle]W TCDSERACCEELRCKL [5-BrW]CRKEI{Amide} |
| 1354 | CyA-[Glu1;Nle6;Pra17;5-BrW24] JzTx-V(1-29) | {H}-[CyA]ECQKW[Nle]W TCDSKRACC[Pra]GLRCKL [5-BrW]CRKII{Amide} |
| 1355 | CyA-[Nle6;Glu12,18;Pra17;5-BrW24] JzTx-V(1-29) | {H}-[CyA]YCQKW[Nle]W TCDSERACC[Pra]ELRCKL [5-BrW]CRKII{Amide} |
| 1356 | Pra-[Glu1;Nle6;5-BrW24]JzTx-V(1-29) | {H}-[Pra]ECQKW[Nle]W TCDSKRACCEGLRCKL [5-BrW]CRKII{Amide} |
| 1357 | Pra-[Nle6;Glu12,18;5-BrW24] JzTx-V(1-29) | {H}-[Pra]YCQKW[Nle]W TCDSERACCEELRCKL [5-BrW]CRKII{Amide} |
| 1358 | CyA-[Glu1,28;hPhe5;Nle6;Pra17; 5-BrW24]JzTx-V(1-29) | {H}-[CyA]ECQK[hPhe] [Nle]WTCDSKRACC[Pra] GLRCKL[5-BrW]CRKEI {Amide} |
| 1359 | CyA-[hPhe5;Nle6;Glu11;28;Pra17; 5-BrW24]JzTx-V(1 -29) | {H}-[CyA]YCQK[hPhe] [Nle]WTCDEKRACC[Pra] GLRCKL[5-BrW]CRKEI {Amide} |
| 1360 | CyA-[hPhe5;Nle6;Glu12,28;Pra17; 5-BrW24]JzTx-V(1 -29) | {H}-[CyA]YCQK[hPhe] [Nle]WTCDSERACC[Pra] GLRCKL[5-BrW]CRKEI {Amide} |
| 1361 | CyA-[hPhe5;Nle6;Glu14,28;Pra17; 5-BrW24]JzTx-V(1 -29) | {H}-[CyA]YCQK[hPhe] [Nle]WTCDSKRECC[Pra] GLRCKL[5-BrW]CRKEI {Amide} |
| 1362 | CyA-[hPhe5;Nle6;Glu11,12,28;Pra17; 5-BrW24]JzTx-V(1-29) | {H}-[CyA]YCQK[hPhe] [Nle]WTCDEERACC[Pra] GLRCKL[5-BrW]CRKEI {Amide} |

TABLE 5-continued

Amino acid sequences of JzTx-V and JzTx-V peptide analogs.

| SEQ ID NO. | Designation | Amino Acid Sequence |
|---|---|---|
| 1363 | CyA-[hPhe5;Nle6;Glu12,18,28;Pra17; 5-BrW24]JzTx-V(1 -29) | {H}-[CyA]YCQK[hPhe] [Nle]WTCDSERACC[Pra] ELRCKL[5-BrW]CRKEI {Amide} |
| 1364 | Pra-[Glu1,28;hPhe5;Nle6;5-BrW24] JzTx-V(1-29) | {H}-[Pra]ECQK[hPhe] [Nle]WTCDSKRACCEGLRC KL[5-BrW]CRKEI{Amide} |
| 1365 | Pra-[hPhe5;Nle6;Glu11,28;5-BrW24] JzTx-V(1-29) | {H}-[Pra]YCQK[hPhe] [Nle]WTCDEKRACCEGLRC KL[5-BrW]CRKEI{Amide} |
| 1366 | Pra-[hPhe5;Nle6;Glu12,28;5-BrW24] JzTx-V(1-29) | {H}-[Pra]YCQK[hPhe] [Nle]WTCDSERACCEGLRC KL[5-BrW]CRKEI{Amide} |
| 1367 | Pra-[hPhe5;Nle6;Glu14,28;5-BrW24] JzTx-V(1-29) | {H}-[Pra]YCQK[hPhe] [Nle]WTCDSKRECCEGLRC KL[5-BrW]CRKEI{Amide} |
| 1368 | Pra-[hPhe5;Nle6;Glu11,12,28; 5-BrW24]JzTx-V(1-29) | {H}-[Pra]YCQK[hPhe] [Nle]WTCDEERACCEGLRC KL[5-BrW]CRKEI{Amide} |
| 1369 | Pra-[hPhe5;Nle6;Glu12,18,28; 5-BrW24]JzTx-V(1-29) | {H}-[Pra]YCQK[hPhe] [Nle]WTCDSERACCEELRC KL[5-BrW]CRKEI{Amide} |
| 1370 | CyA-[Glu1;hPhe5;Nle6;Pra17; 5-BrW24]JzTx-V(1-29) | {H}-[CyA]ECQK[hPhe] [Nle]WTCDSKRACC[Pra] GLRCKL[5-BrW]CRKII {Amide} |
| 1371 | CyA-[hPhe5;Nle6;Glu11;Pra17; 5-BrW24]JzTx-V(1-29) | {H}-[CyA]YCQK[hPhe] [Nle]WTCDEKRACC[Pra] GLRCKL[5-BrW]CRKII {Amide} |
| 1372 | CyA-[hPhe5;Nle6;Glu12;Pra17; 5-BrW24]JzTx-V(1-29) | {H}-[CyA]YCQK[hPhe] [Nle]WTCDSERACC[Pra] GLRCKL[5-BrW]CRKII {Amide} |
| 1373 | CyA-[hPhe5;Nle6;Glu14;Pra17; 5-BrW24]JzTx-V(1-29) | {H}-[CyA]YCQK[hPhe] [Nle]WTCDSKRECC[Pra] GLRCKL[5-BrW]CRKII {Amide} |
| 1374 | CyA-[hPhe5;Nle6;Glu11,12;Pra17; 5-BrW24]JzTx-V(1-29) | {H}-[CyA]YCQK[hPhe] [Nle]WTCDEERACC[Pra] GLRCKL[5-BrW]CRKII {Amide} |
| 1375 | CyA-[hPhe5;Nle6;Glu12,18;Pra17; 5-BrW24]JzTx-V(1-29) | {H}-[CyA]YCQK[hPhe] [Nle]WTCDSERACC[Pra] ELRCKL[5-BrW]CRKII {Amide} |
| 1376 | Pra-[Glu1;hPhe5;Nle6;5-BrW24] JzTx-V(1-29) | {H}-[Pra]ECQK[hPhe] [Nle]WTCDSKRACCEGLRC KL[5-BrW]CRKII{Amide} |
| 1377 | Pra-[hPhe5;Nle6;Glu11;5-BrW24] JzTx-V(1-29) | {H}-[Pra]YCQK[hPhe] [Nle]WTCDEKRACCEGLRC KL[5-BrW]CRKII{Amide} |
| 1378 | Pra-[hPhe5;Nle6;Glu12;5-BrW24] JzTx-V(1-29) | {H}-[Pra]YCQK[hPhe] [Nle]WTCDSERACCEGLRC KL[5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 1379 | Pra-[hPhe5;Nle6;Glu14;5-BrW24] JzTx-V(1-29) | {H}-[Pra]YCQK[hPhe] [Nle]WTCDSKRECCEGLRC KL[5-BrW]CRKII{Amide} |
| 1380 | Pra-[hPhe5;Nle6;Glu11,12;5-BrW24] JzTx-V(1-29) | {H}-[Pra]YCQK[hPhe] [Nle]WTCDEERACCEGLRC KL[5-BrW]CRKII{Amide} |
| 1381 | Pra-[hPhe5;Nle6;Glu12,18;5-BrW24] JzTx-V(1-29) | {H}-[Pra]YCQK[hPhe] [Nle]WTCDSERACCEELRC KL[5-BrW]CRKII{Amide} |
| 1382 | CyA-[Glu1,28;Nle6;Pra17;Chg23; 5-BrW24]JzTx-V(1-29) | {H}-[CyA]ECQKW[Nle]W TCDSKRACC[Pra]GLRCK [Chg][5-BrW]CRKEI {Amide} |
| 1383 | CyA-[Nle6;Glu11,28;Pra17;Chg23; 5-BrW24]JzTx-V(1-29) | {H}-[CyA]YCQKW[Nle]W TCDEKRACC[Pra]GLRCK [Chg][5-BrW]CRKEI {Amide} |
| 1384 | CyA-[Nle6;Glu12,28;Pra17;Chg23; 5-BrW24]JzTx-V(1-29) | {H}-[CyA]YCQKW[Nle]W TCDSERACC[Pra]GLRCK [Chg][5-BrW]CRKEI {Amide} |
| 1385 | CyA-[Nle6;Glu14,28;Pra17;Chg23; 5-BrW24]JzTx-V(1-29) | {H}-[CyA]YCQKW[Nle]W TCDSKRECC[Pra]GLRCK [Chg][5-BrW]CRKEI {Amide} |
| 1386 | CyA-[Nle6;Glu11,12,28;Pra17; Chg23;5-BrW24]JzTx-V(1-29) | {H}-[CyA]YCQKW[Nle]W TCDEERACC[Pra]GLRCK [Chg][5-BrW]CRKEI {Amide} |
| 1387 | CyA-[Nle6;Glu12,18,28;Pra17; Chg23;5-BrW24]JzTx-V(1-29) | {H}-[CyA]YCQKW[Nle]W TCDSERACC[Pra]ELRCK [Chg][5-BrW]CRKEI {Amide} |
| 1388 | Pra-[Glu1,28;Nle6;Chg23;5-BrW24] JzTx-V(1-29) | {H}-[Pra]ECQKW[Nle]W TCDSKRACCEGLRCK[Chg] [5-BrW]CRKEI{Amide} |
| 1389 | Pra-[Nle6;Glu11,28;Chg23;5-BrW24] JzTx-V(1-29) | {H}-[Pra]YCQKW[Nle]W TCDEKRACCEGLRCK[Chg] [5-BrW]CRKEI{Amide} |
| 1390 | Pra-[Nle6;Glu12,28;Chg23;5-BrW24] JzTx-V(1-29) | {H}-[Pra]YCQKW[Nle]W TCDSERACCEGLRCK[Chg] [5-BrW]CRKEI{Amide} |
| 1391 | Pra-[Nle6;Glu14,28;Chg23;5-BrW24] JzTx-V(1-29) | {H}-[Pra]YCQKW[Nle]W TCDSKRECCEGLRCK[Chg] [5-BrW]CRKEI{Amide} |
| 1392 | Pra-[Nle6;Glu11,12,28;Chg23; 5-BrW24]JzTx-V(1-29) | {H}-[Pra]YCQKW[Nle]W TCDEERACCEGLRCK[Chg] [5-BrW]CRKEI{Amide} |
| 1393 | Pra-[Nle6;Glu12,18,28;Chg23; 5-BrW24]JzTx-V(1-29) | {H}-[Pra]YCQKW[Nle]W TCDSERACCEELRCK[Chg] [5-BrW]CRKEI{Amide} |
| 1394 | CyA-[Glu1;Nle6;Pra17;Chg23; 5-BrW24]JzTx-V(1-29) | {H}-[CyA]ECQKW[Nle]W TCDSKRACC[Pra]GLRCK [Chg][5-BrW]CRKII {Amide} |

TABLE 5-continued

Amino acid sequences of JzTx-V and JzTx-V peptide analogs.

| SEQ ID NO. | Designation | Amino Acid Sequence |
|---|---|---|
| 1395 | CyA-[Nle6;Glu11;Pra17;Chg23; 5-BrW24]JzTx-V(1-29) | {H}-[CyA]YCQKW[Nle]W TCDEKRACC[Pra]GLRCK [Chg][5-BrW]CRKII {Amide} |
| 1396 | CyA-[Nle6;Glu12;Pra17;Chg23; 5-BrW24]JzTx-V(1-29) | {H}-[CyA]YCQKW[Nle]W TCDSERACC[Pra]GLRCK [Chg][5-BrW]CRKII {Amide} |
| 1397 | CyA-[Nle6;Glu14;Pra17;Chg23; 5-BrW24]JzTx-V(1-29) | {H}-[CyA]YCQKW[Nle]W TCDSKRECC[Pra]GLRCK [Chg][5-BrW]CRKII {Amide} |
| 1398 | CyA-[Nle6;Glu11,12;Pra17;Chg23; 5-BrW24]JzTx-V(1-29) | {H}-[CyA]YCQKW[Nle]W TCDEERACC[Pra]GLRCK [Chg][5-BrW]CRKII {Amide} |
| 1399 | CyA-[Nle6;Glu12,18;Pra17;Chg23; 5-BrW24]JzTx-V(1-29) | {H}-[CyA]YCQKW[Nle]W TCDSERACC[Pra]ELRCK [Chg][5-BrW]CRKII {Amide} |
| 1400 | Pra-[Glu1;Nle6;Chg23;5-BrW24] JzTx-V(1-29) | {H}-[Pra]ECQKW[Nle]W TCDSKRACCEGLRCK[Chg] [5-BrW]CRKII{Amide} |
| 1401 | Pra-[Nle6;Glu11;Chg23;5-BrW24] JzTx-V(1-29) | {H}-[Pra]YCQKW[Nle]W TCDEKRACCEGLRCK[Chg] [5-BrW]CRKII{Amide} |
| 1402 | Pra-[Nle6;Glu12;Chg23;5-BrW24] JzTx-V(1-29) | {H}-[Pra]YCQKW[Nle]W TCDSERACCEGLRCK[Chg] [5-BrW]CRKII{Amide} |
| 1403 | Pra-[Nle6;Glu14;Chg23;5-BrW24] JzTx-V(1-29) | {H}-[Pra]YCQKW[Nle]W TCDSKRECCEGLRCK[Chg] [5-BrW]CRKII{Amide} |
| 1404 | Pra-[Nle6;Glu11,12;Chg23; 5-BrW24]JzTx-V(1-29) | {H}-[Pra]YCQKW[Nle]W TCDEERACCEGLRCK[Chg] [5-BrW]CRKII{Amide} |
| 1405 | Pra-[Nle6;Glu12,18;Chg23; 5-BrW24]JzTx-V(1-29) | {H}-[Pra]YCQKW[Nle]W TCDSERACCEELRCK[Chg] [5-BrW]CRKII{Amide} |
| 1406 | CyA-[Glu1,28;Nle6;Pra17;5-BrW24; Phe29]JzTx-V(1-29) | {H}-[CyA]ECQKW[Nle]W TCDSKRACC[Pra]GLRCKL [5-BrW]CRKEF{Amide} |
| 1407 | CyA-[Nle6;Glu11,28;Pra17;5-BrW24; Phe29]JzTx-V(1-29) | {H}-[CyA]YCQKW[Nle]W TCDEKRACC[Pra]GLRCKL [5-BrW]CRKEF{Amide} |
| 1408 | CyA-[Nle6;Glu12,28;Pra17;5-BrW24; Phe29]JzTx-V(1-29) | {H}-[CyA]YCQKW[Nle]W TCDSERACC[Pra]GLRCKL [5-BrW]CRKEF{Amide} |
| 1409 | CyA-[Nle6;Glu14,28;Pra17;5-BrW24; Phe29]JzTx-V(1-29) | {H}-[CyA]YCQKW[Nle]W TCDSKRECC[Pra]GLRCKL [5-BrW]CRKEF{Amide} |
| 1410 | CyA-[Nle6;Glu11,12,28;Pra17; 5-BrW24;Phe29]JzTx-V(1-29) | {H}-[CyA]YCQKW[Nle]W TCDEERACC[Pra]GLRCKL [5-BrW]CRKEF{Amide} |
| 1411 | CyA-[Nle6;Glu12,18,28;Pra17; 5-BrW24;Phe29]JzTx-V(1-29) | {H}-[CyA]YCQKW[Nle]W TCDSERACC[Pra]ELRCKL [5-BrW]CRKEF{Amide} |

TABLE 5-continued

Amino acid sequences of JzTx-V and JzTx-V peptide analogs.

| SEQ ID NO. | Designation | Amino Acid Sequence |
|---|---|---|
| 1412 | Pra-[Glu1,28;Nle6;5-BrW24;Phe29] JzTx-V(1-29) | {H}-[Pra]ECQKW[Nle]W TCDSKRACCEGLRCKL [5-BrW]CRKEF{Amide} |
| 1413 | Pra-[Nle6;Glu11,28;5-BrW24;Phe29] JzTx-V(1-29) | {H}-[Pra]YCQKW[Nle]W TCDEKRACCEGLRCKL [5-BrW]CRKEF{Amide} |
| 1414 | Pra-[Nle6;Glu12,28;5-BrW24;Phe29] JzTx-V(1-29) | {H}-[Pra]YCQKW[Nle]W TCDSERACCEGLRCKL [5-BrW]CRKEF{Amide} |
| 1415 | Pra-[Nle6;Glu14,28;5-BrW24;Phe29] JzTx-V(1-29) | {H}-[Pra]YCQKW[Nle]W TCDSKRECCEGLRCKL [5-BrW]CRKEF{Amide} |
| 1416 | Pra-[Nle6;Glu11,12,28;5-BrW24;Phe29] JzTx-V(1-29) | {H}-[Pra]YCQKW[Nle]W TCDEERACCEGLRCKL [5-BrW]CRKEF{Amide} |
| 1417 | Pra-[Nle6;Glu12,18,28;5-BrW24;Phe29] JzTx-V(1-29) | {H}-[Pra]YCQKW[Nle]W TCDSERACCEELRCKL [5-BrW]CRKEF{Amide} |
| 1418 | CyA-[Glu1;Nle6;Pra17;5-BrW24;Phe29] JzTx-V(1-29) | {H}-[CyA]ECQKW[Nle]W TCDSKRACC[Pra]GLRCKL [5-BrW]CRKIF{Amide} |
| 1419 | CyA-[Nle6;Glu11;Pra17;5-BrW24; Phe29]JzTx-V(1-29) | {H}-[CyA]YCQKW[Nle]W TCDEKRACC[Pra]GLRCKL [5-BrW]CRKIF{Amide} |
| 1420 | CyA-[Nle6;Glu12;Pra17;5-BrW24; Phe29]JzTx-V(1-29) | {H}-[CyA]YCQKW[Nle]W TCDSERACC[Pra]GLRCKL [5-BrW]CRKIF{Amide} |
| 1421 | CyA-[Nle6;Glu14;Pra17;5-BrW24; Phe29]JzTx-V(1-29) | {H}-[CyA]YCQKW[Nle]W TCDSKRECC[Pra]GLRCKL [5-BrW]CRKIF{Amide} |
| 1422 | CyA-[Nle6;Glu11,12;Pra17;5-BrW24; Phe29]JzTx-V(1-29) | {H}-[CyA]YCQKW[Nle]W TCDEERACC[Pra]GLRCKL [5-BrW]CRKIF{Amide} |
| 1423 | CyA-[Nle6;Glu12,18;Pra17;5-BrW24; Phe29]JzTx-V(1-29) | {H}-[CyA]YCQKW[Nle]W TCDSERACC[Pra]ELRCKL [5-BrW]CRKIF{Amide} |
| 1424 | Pra-[Glu1;Nle6;5-BrW24;Phe29] JzTx-V(1-29) | {H}-[Pra]ECQKW[Nle]W TCDSKRACCEGLRCKL [5-BrW]CRKIF{Amide} |
| 1425 | Pra-[Nle6;Glu11;5-BrW24;Phe29] JzTx-V(1-29) | {H}-[Pra]YCQKW[Nle]W TCDEKRACCEGLRCKL [5-BrW]CRKIF{Amide} |
| 1426 | Pra-[Nle6;Glu12;5-BrW24;Phe29] JzTx-V(1-29) | {H}-[Pra]YCQKW[Nle]W TCDSERACCEGLRCKL [5-BrW]CRKIF{Amide} |
| 1427 | Pra-[Nle6;Glu14;5-BrW24;Phe29] JzTx-V(1-29) | {H}-[Pra]YCQKW[Nle]W TCDSKRECCEGLRCKL [5-BrW]CRKIF{Amide} |
| 1428 | Pra-[Nle6;Glu11,12;5-BrW24;Phe29] JzTx-V(1-29) | {H}-[Pra]YCQKW[Nle]W TCDEERACCEGLRCKL [5-BrW]CRKIF{Amide} |
| 1429 | Pra-[Nle6;Glu12,18;5-BrW24;Phe29] JzTx-V(1-29) | {H}-[Pra]YCQKW[Nle]W TCDSERACCEELRCKL [5-BrW]CRKIF{Amide} |

TABLE 5-continued

Amino acid sequences of JzTx-V and JzTx-V peptide analogs.

| SEQ ID NO. | Designation | Amino Acid Sequence |
|---|---|---|
| 1430 | Pra-[Nle6;Glu14,28;Val20;5-BrW24] JzTx-V(1-29) | {H}-[Pra]YCQKW[Nle]W TCDSKRECCEGLVCKL [5-BrW]CRKEI{Amide} |
| 1431 | Pra-[Nle6;Glu14;Val20;5-BrW24] JzTx-V(1-29) | {H}-[Pra]YCQKW[Nle]W TCDSKRECCEGLVCKL [5-BrW]CRKII{Amide} |
| 1432 | CyA-[Glu1,28;hPhe5;Nle6;Pra17; Val20;5-BrW24]JzTx-V(1-29) | {H}-[Cya]ECQK[hPhe] [Nle]WTCDSKRACC[Pra] GLVCKL[5-BrW]CRKEI {Amide} |
| 1433 | CyA-[hPhe5;Nle6;Glu11,28;Pra17; Val20;5-BrW24]JzTx-V(1-29) | {H}-[CyA]YCQK[hPhe] [Nle]WTCDEKRACC[Pra] GLVCKL[5-BrW]CRKEI {Amide} |
| 1434 | Cya-[hPhe5;Nle6;Glu12,28;Pra17; Val20;5-BrW24]JzTx-V(1-29) | {H}-[CyA]YCQK[hPhe] [Nle]WTCDSERACC[Pra] GLVCKL[5-BrW]CRKEI {Amide} |
| 1435 | CyA-[hPhe5;Nle6;Glu14,28;Pra17; Val20;5-BrW24]JzTx-V(1-29) | {H}-[CyA]YCQK[hPhe] [Nle]WTCDSKRECC[Pra] GLVCKL[5-BrW]CRKEI {Amide} |
| 1436 | CyA-[hPhe5;Nle6;Glu11,12,28;Pra17; Val20;5-BrW24]JzTx-V(1-29) | {H}-[CyA]YCQK[hPhe] [Nle]WTCDEERACC[Pra] GLVCKL[5-BrW]CRKEI {Amide} |
| 1437 | CyA-[hPhe5;Nle6;Glu12,18,28;Pra17; Val20;5-BrW24]JzTx-V(1-29) | {H}-[CyA]YCQK[hPhe] [Nle]WTCDSERACC[Pra] ELVCKL[5-BrW]CRKEI {Amide} |
| 1438 | Pra-[Glu1,28;hPhe5;Nle6;Val20; 5-BrW24]JzTx-V(1-29) | {H}-[Pra]ECQK[hPhe] [Nle]WTCDSKRACCEGLVC KL[5-BrW]CRKEI{Amide} |
| 1439 | Pra-[hPhe5;Nle6;Glu11,28;Val20; 5-BrW24]JzTx-V(1-29) | {H}-[Pra]YCQK[hPhe] [Nle]WTCDEKRACCEGLVC KL[5-BrW]CRKEI{Amide} |
| 1440 | Pra-[hPhe5;Nle6;Glu12,28;Val20; 5-BrW24]JzTx-V(1-29) | {H}-[Pra]YCQK[hPhe] [Nle]WTCDSERACCEGLVC KL[5-BrW]CRKEI{Amide} |
| 1441 | Pra-[hPhe5;Nle6;Glu14,28;Val20; 5-BrW24]JzTx-V(1-29) | {H}-[Pra]YCQK[hPhe] [Nle]WTCDSKRECCEGLVC KL[5-BrW]CRKEI{Amide} |
| 1442 | Pra-[hPhe5;Nle6;Glu11,12,28; Val20;5-BrW24]JzTx-V(1-29) | {H}-[Pra]YCQK[hPhe] [Nle]WTCDEERACCEGLVC KL[5-BrW]CRKEI{Amide} |
| 1443 | Pra-[hPhe5;Nle6;Glu12,18,28; Val20;5-BrW24]JzTx-V(1-29) | {H}-[Pra]YCQK[hPhe] [Nle]WTCDSERACCEELVC KL[5-BrW]CRKEI{Amide} |
| 1444 | CyA-[Glu1;hPhe5;Nle6;Pra17; Val20;5-BrW24]JzTx-V(1-29) | {H}-[CyA]ECQK[hPhe] [Nle]WTCDSKRACC[Pra] GLVCKL[5-BrW]CRKII {Amide} |
| 1445 | CyA-[hPhe5;Nle6;Glu11;Pra17; Val20;5-BrW24]JzTx-V(1-29) | {H}-[CyA]YCQK[hPhe] [Nle]WTCDEKRACC[Pra] GLVCKL[5-BrW]CRKII {Amide} |

TABLE 5-continued

Amino acid sequences of JzTx-V and JzTx-V peptide analogs.

| SEQ ID NO. | Designation | Amino Acid Sequence |
|---|---|---|
| 1446 | CyA-[hPhe5;Nle6;Glu12;Pra17; Val20;5-BrW24]JzTx-V(1 -29) | {H}-[CyA]YCQK[hPhe] [Nle]WTCDSERACC[Pra] GLVCKL[5-BrW]CRKII {Amide} |
| 1447 | CyA-[hPhe5;Nle6;Glu14;Pra17; Val20;5-BrW24]JzTx-V(1-29) | {H}-[CyA]YCQK[hPhe] [Nle]WTCDSKRECC[Pra] GLVCKL[5-BrW]CRKII {Amide} |
| 1448 | CyA-[hPhe5;Nle6;Glu11,12;Pra17; Val20;5-BrW24]JzTx-V(1-29) | {H}-[CyA]YCQK[hPhe] [Nle]WTCDEERACC[Pra] GLVCKL[5-BrW]CRKII {Amide} |
| 1449 | CyA-[hphe5;Nle6;Glu12,18;Pra17; Val20;5-BrW24]JzTx-V(1-29) | {H}-[CyA]YCQK[hPhe] [Nle]WTCDSERACC[Pra] ELVCKL[5-BrW]CRKII {Amide} |
| 1450 | Pra-[Glu1;hPhe5;Nle6;Val20; 5-BrW24]JzTx-V(1-29) | {H}-[CyA]YCQK[hPhe] [Nle]WTCDSKRACCEGLVC KL[5-BrW]CRKII{Amide} |
| 1451 | Pra-[hPhe5;Nle6;Glu11;Val20; 5-BrW24]JzTx-V(1-29) | {H}-[Pra]YCQK[hPhe] [Nle]WTCDEKRACCEGLVC KL[5-BrW]CRKII{Amide} |
| 1452 | Pra-[hPhe5;Nle6;Glu12;Val20; 5-BrW24]JzTx-V(1-29) | {H}-[Pra]YCQK[hPhe] [Nle]WTCDSERACCEGLVC KL[5-BrW]CRKII{Amide} |
| 1453 | Pra-[hPhe5;Nle6;Glu14;Val20; 5-BrW24]JzTx-V(1-29) | {H}-[Pra]YCQK[hPhe] [Nle]WTCDSKRECCEGLVC KL[5-BrW]CRKII{Amide} |
| 1454 | Pra-[hPhe5;Nle6;Glu11,12;Val20; 5-BrW24]JzTx-V(1-29) | {H}-[Pra]YCQK[hPhe] [Nle]WTCDEERACCEGLVC KL[5-BrW]CRKII{Amide} |
| 1455 | Pra-[hPhe5;Nle6;Hlu12,18;Val20; 5-BrW24]JzTx-V(1 -29) | {H}-[Pra]YCQK[hPhe] [Nle]WTCDSERACCEELVC KL[5-BrW]CRKII{Amide} |
| 1456 | CyA-[Glu1,28;Nle6;Pra17;Val20; Chg23;5-BrW24]JzTx-V(1-29) | {H}-[CyA]ECQKW[Nle]W TCDSKRACC[Pra]GLVCK [Chg][5-BrW]CRKEI {Amide} |
| 1457 | CyA-[Nle6;Glu11,28;Pra17;Val20; Chg23;5-BrW24]JzTx-V(1-29) | {H}-[CyA]ECQKW[Nle]W TCDSKRACC[Pra]GLVCK [Chg][5-BrW]CRKEI {Amide} |
| 1458 | CyA-[Nle6;Glu12,28;Pra17;Val20; Chg23;5-BrW24]JzTx-V(1-29) | {H}-[CyA]YCQKW[Nle]W TCDSERACC[Pra]GLVCK [Chg][5-BrW]CRKEI {Amide} |
| 1459 | CyA-[Nle6;Glu14,28;Pra17;Val20; Chg23;5-BrW24]JzTx-V(1-29) | {H}-[CyA]YCQKW[Nle]W TCDSKRECC[Pra]GLVCK [Chg][5-BrW]CRKEI {Amide} |
| 1460 | CyA-[Nle6;Glu11,12,28;Pra17;Val20; Chg23;5-BrW24]JzTx-V(1-29) | {H}-[CyA]YCQKW[Nle]W TCDEERACC[Pra]GLVCK [Chg][5-BrW]CRKEI {Amide} |
| 1461 | CyA-[Nle6;Glu12,18,28;Pra17;Val20; Chg23;5-BrW24]JzTx-V(1-29) | {H}-[CyA]YCQKW[Nle]W TCDSERACC[Pra]ELVCK [Chg][5-BrW]CRKEI {Amide} |

TABLE 5-continued

Amino acid sequences of JzTx-V and JzTx-V peptide analogs.

| SEQ ID NO. | Designation | Amino Acid Sequence |
|---|---|---|
| 1462 | Pra-[Glu1,28;Nle6;Val20;Chg23; 5-BrW24]JzTx-V(1-29) | {H}-[Pra]ECQKW[Nle]W TCDSKRACCEGLVCK[Chg] [5-BrW]CRKEI{Amide} |
| 1463 | Pra-[Nle6;Glu11,28;Val20;Chg23; 5-BrW24]JzTx-V(1-29) | {H}-[Pra]YCQKW[Nle]W TCDEKRACCEGLVCK[Chg] [5-BrW]CRKEI{Amide} |
| 1464 | Pra-[Nle6;Glu12,28;Val20;Chg23; 5-BrW24]JzTx-V(1-29) | {H}-[Pra]YCQKW[Nle]W TCDSERACCEGLVCK[Chg] [5-BrW]CRKEI{Amide} |
| 1465 | Pra-[Nle6;Glu14,28;Val20;Chg23; 5-BrW24]JzTx-V(1-29) | {H}-[Pra]YCQKW[Nle]W TCDSKRECCEGLVCK[Chg] [5-BrW]CRKEI{Amide} |
| 1466 | Pra-[Nle6;Glu11,12,28;Val20; Chg23;5-BrW24]JzTx-V(1-29) | {H}-[Pra]YCQKW[Nle]W TCDEERACCEGLVCK[Chg] [5-BrW]CRKEI{Amide} |
| 1467 | Pra-[Nle6;Glu12,18,28;Val20; Chg23;5-BrW24]JzTx-V(1-29) | {H}-[Pra]YCQKW[Nle]W TCDSERACCEELVCK[Chg] [5-BrW]CRKEI{Amide} |
| 1468 | CyA-[Glu1;Nle6;Pra17;Val20; Chg23;5-BrW24]JzTx-V(1-29) | {H}-[CyA]ECQKW[Nle]W TCDSKRACC[Pra]GLVCK [Chg][5-BrW]CRKII {Amide} |
| 1469 | CyA-[Nle6;Glu11;Pra17;Val20; Chg23;5-BrW24]JzTx-V(1-29) | {H}-[CyA]YCQKW[Nle]W TCDEKRACC[Pra]GLVCK [Chg][5-BrW]CRKII {Amide} |
| 1470 | CyA-[Nle6;Glu12;Pra17;Val20; Chg23;5-BrW24]JzTx-V(1-29) | {H}-[CyA]YCQKW[Nle]W TCDSERACC[Pra]GLVCK [Chg][5-BrW]CRKII {Amide} |
| 1471 | CyA-[Nle6;Glu14;Pra17;Val20; Chg23;5-BrW24]JzTx-V(1-29) | {H}-[CyA]YCQKW[Nle]W TCDSKRECC[Pra]GLVCK [Chg][5-BrW]CRKII {Amide} |
| 1472 | CyA-[Nle6;Glu11,12;Pra17;Val20; Chg23;5-BrW24]JzTx-V(1-29) | {H}-[CyA]YCQKW[Nle]W TCDEERACC[Pra]GLVCK [Chg][5-BrW]CRKII {Amide} |
| 1473 | CyA-[Nle6;Glu12,18;Pra17;Val20; Chg23;5-BrW24]JzTx-V(1-29) | {H}-[CyA]YCQKW[Nle]W TCDSERACC[Pra]ELVCK [Chg][5-BrW]CRKII {Amide} |
| 1474 | Pra-[Glu1;Nle6;Val20;Chg23; 5-BrW24]JzTx-V(1-29) | {H}-[Pra]ECQKW[Nle]W TCDSKRACCEGLVCK[Chg] [5-BrW]CRKII{Amide} |
| 1475 | Pra-[Nle6;Glu11;Val20;Chg23; 5-BrW24]JzTx-V(1-29) | {H}-[Pra]YCQKW[Nle]W TCDEKRACCEGLVCK[Chg] [5-BrW]CRKII{Amide} |
| 1476 | Pra-[Nle6;Glu12;Val20;Chg23; 5-BrW24]JzTx-V(1-29) | {H}-[Pra]YCQKW[Nle]W TCDSERACCEGLVCK[Chg] [5-BrW]CRKII{Amide} |
| 1477 | Pra-[Nle6;Glu14;Val20;Chg23; 5-BrW24]JzTx-V(1-29) | {H}-[Pra]YCQKW[Nle]W TCDSKRECCEGLVCK[Chg] [5-BrW]CRKII{Amide} |

TABLE 5-continued

Amino acid sequences of JzTx-V and JzTx-V peptide analogs.

| SEQ ID NO. | Designation | Amino Acid Sequence |
|---|---|---|
| 1478 | Pra-[Nle6;Glu11,12;Val20;Chg23; 5-BrW24]JzTx-V(1-29) | {H}-[Pra]YCQKW[Nle]W TCDEERACCEGLVCK[Chg] [5-BrW]CRKII{Amide} |
| 1479 | Pra-[Nle6;Glu12,18;Val20;Chg23; 5-BrW24]JzTx-V(1-29) | {H}-[Pra]YCQKW[Nle]W TCDSERACCEELVCK[Chg] [5-BrW]CRKII{Amide} |
| 1480 | CyA-[Glu1,28;Nle6;Pra17;Val20; 5-BrW24;Phe29]JzTx-V(1-29) | {H}-[CyA]ECQKW[Nle]W TCDSKRACC[Pra]GLVCKL [5-BrW]CRKEF{Amide} |
| 1481 | CyA-[Nle6;Glu11,28;Pra17;Val20; 5-BrW24;Phe29]JzTx-V(1-29) | {H}-[CyA]YCQKW[Nle]W TCDEKRACC[Pra]GLVCKL [5-BrW]CRKEF{Amide} |
| 1482 | CyA-[Nle6;Glu12,28;Pra17;Val20; 5-BrW24;Phe29]JzTx-V(1-29) | {H}-[CyA]YCQKW[Nle]W TCDSERACC[Pra]GLVCKL [5-BrW]CRKEF{Amide} |
| 1483 | CyA-[Nle6;Glu14,28;Pra17;Val20; 5-BrW24;Phe29]JzTx-V(1-29) | {H}-[CyA]YCQKW[Nle]W TCDSKRECC[Pra]GLVCKL [5-BrW]CRKEF{Amide} |
| 1484 | CyA-[Nle6;Glu11,12,28;Pra17;Val20; 5-BrW24;Phe29]JzTx-V(1-29) | {H}-[CyA]YCQKW[Nle]W TCDEERACC[Pra]GLVCKL [5-BrW]CRKEF{Amide} |
| 1485 | CyA-[Nle6;Glu12,18,28;Pra17;Val20; 5-BrW24;Phe29]JzTx-V(1-29) | {H}-[CyA]YCQKW[Nle]W TCDSERACC[Pra]ELVCKL [5-BrW]CRKEF{Amide} |
| 1486 | Pra-[Glu1,28;Nle6;Val20;5-BrW24; Phe29]JzTx-V(1-29) | {H}-[Pra]ECQKW[Nle]W TCDSKRACCEGLVCKL [5-BrW]CRKEF{Amide} |
| 1487 | Pra-[Nle6;Glu11,28;Val20;5-BrW24; Phe29]JzTx-V(1-29) | {H}-[Pra]YCQKW[Nle]W TCDEKRACCEGLVCKL [5-BrW]CRKEF{Amide} |
| 1488 | Pra-[Nle6;Glu12,28;Val20;5-BrW24; Phe29]JzTx-V(1-29) | {H}-[Pra]YCQKW[Nle]W TCDSERACCEGLVCKL [5-BrW]CRKEF{Amide} |
| 1489 | Pra-[Nle6;Glu14,28;Val20;5-BrW24; Phe29]JzTx-V(1-29) | {H}-[Pra]YCQKW[Nle]W TCDSKRECCEGLVCKL [5-BrW]CRKEF{Amide} |
| 1490 | Pra-[Nle6;Glu11,12,28;Val20; 5-BrW24;Phe29]JzTx-V(1-29) | {H}-[Pra]YCQKW[Nle]W TCDEERACCEGLVCKL [5-BrW]CRKEF{Amide} |
| 1491 | Pra-[Nle6;Glu12,18,28;Val20; 5-BrW24;Phe29]JzTx-V(1-29) | {H}-[Pra]YCQKW[Nle]W TCDSERACCEELVCKL [5-BrW]CRKEF{Amide} |
| 1492 | CyA-[Glu1;Nle6;Pra17;Val20; 5-BrW24;Phe29]JzTx-V(1-29) | {H}-[CyA]ECQKW[Nle]W TCDSKRACC[Pra]GLVCKL [5-BrW]CRKIF{Amide} |
| 1493 | CyA-[Nle6;Glu11;Pra17;Val20; 5-BrW24;Phe29]JzTx-V(1-29) | {H}-[CyA]YCQKW[Nle]W TCDEKRACC[Pra]GLVCKL [5-BrW]CRKIF{Amide} |
| 1494 | CyA-[Nle6;Glu12;Pra17;Val20; 5-BrW24;Phe29]JzTx-V(1-29) | {H}-[CyA]YCQKW[Nle]W TCDSERACC[Pra]GLVCKL [5-BrW]CRKIF{Amide} |
| 1495 | CyA-+Nle6;Glu14;Pral 7;Va120; 5-BrW24;Phe29+JzTx-V(1-29) | {H}-[CyA]YCQKW[Nle]W TCDSKRECC[Pra]GLVCKL [5-BrW]CRKIF{Amide} |

TABLE 5-continued

Amino acid sequences of JzTx-V and JzTx-V peptide analogs.

| SEQ ID NO. | Designation | Amino Acid Sequence |
|---|---|---|
| 1496 | CyA-[Nle6;Glu11,12;Pra17;Val20; 5-BrW24;Phe29]JzTx-V(1-29) | {H}-[CyA]YCQKW[Nle]W TCDEERACC[Pra]GLVCKL [5-BrW]CRKIF{Amide} |
| 1497 | CyA-[Nle6;Glu12,18;Pra17;Val20; 5-BrW24;Phe29]JzTx-V(1-29) | {H}-[CyA]YCQKW[Nle]W TCDSERACC[Pra]ELVCKL [5-BrW]CRKIF{Amide} |
| 1498 | Pra-[Glu1;Nle6;Val20;5-BrW24; Phe29]JzTx-V(1-29) | {H}-[Pra]ECQKW[Nle]W TCDSKRACCEGLVCKL [5-BrW]CRKIF{Amide} |
| 1499 | Pra-[Nle6;Glu11;Val20;5-BrW24; Phe29]JzTx-V(1-29) | {H}-[Pra]YCQKW[Nle]W TCDEKRACCEGLVCKL [5-BrW]CRKIF{Amide} |
| 1500 | Pra-[Nle6;Glu12;Val20;5-BrW24; Phe29]JzTx-V(1-29) | {H}-[Pra]YCQKW[Nle]W TCDSERACCEGLVCKL [5-BrW]CRKIF{Amide} |
| 1501 | Pra-[Nle6;Glu14;Val20;5-BrW24; Phe29]JzTx-V(1-29) | {H}-[Pra]YCQKW[Nle]W TCDSKRECCEGLVCKL [5-BrW]CRKIF{Amide} |
| 1502 | Pra-[Nle6;Glu11,12;Val20;5-BrW24; Phe29]JzTx-V(1-29) | {H}-[Pra]YCQKW[Nle]W TCDEERACCEGLVCKL [5-BrW]CRKIF{Amide} |
| 1503 | Pra-[Nle6;Glu12,18;Val20;5-BrW24; Phe29]JzTx-V(1-29) | {H}-[Pra]YCQKW[Nle]W TCDSERACCEELVCKL [5-BrW]CRKIF{Amide} |
| 1504 | hPra-[Nle6]JzTx-V(1-29) | {H}-[Pra]YCQKW[Nle]W TCDSKRACCEGLRCKLWCRK II{Amide} |
| 1505 | CyA-[hPra1;Nle6]JzTx-V(1-29) | {H}-[CyA][hPra]CQKW [Nle]WTCDSKRACCEGLRC KLWCRKII{Amide} |
| 1506 | CyA-[Nle6;hPra11]JzTx-V(1-29) | {H}-[CyA]YCQKW[Nle]W TCD[hPra]KRACCEGLRCK LWCRKII{Amide} |
| 1507 | CyA-[Nle6;hPra12]JzTx-V(1-29) | {H}-[CyA]YCQKW[Nle]W TCDS[hPra]RACCEGLRCK LWCRKII{Amide} |
| 1508 | CyA-[Nle6;hPra14]JzTx-V(1-29) | {H}-[CyA]YCQKW[Nle]W TCDSKR[hPra]CCEGLRCK LWCRKII{Amide} |
| 1509 | CyA-[Nle6;hPra17]JzTx-V(1-29) | {H}-[CyA]YCQKW[Nle]W TCDSKRACC[hPra]GLRCK LWCRKII{Amide} |
| 1510 | hPra-[Nle6;Glu28]JzTx-V(1-29) | {H}-[hPra]YCQKW[Nle] WTCDSKRACCEGLRCKLWCR KEI{Amide} |
| 1511 | CyA-[hPra1;Nle6;Glu28]JzTx-V(1-29) | {H}-[CyA][hPra]CQKW [Nle]WTCDSKRACCEGLRC KLWCRKEI{Amide} |
| 1512 | CyA-+Nle6;hPra11;Glu28+JzTx-V(1-29) | {H}-[CyA]YCQKW[Nle]W TCD[hPra]KRACCEGLRCK LWCRKEI{Amide} |
| 1513 | CyA-[Nle6;hPra12;Glu28]JzTx-V(1-29) | {H}-[CyA]YCQKW[Nle]W TCDS[hPra]RACCEGLRCK LWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 1514 | CyA-[Nle6;hPra14;Glu28]JzTx-V(1-29) | {H}-[CyA]YCQKW[Nle]W TCDSKR[hPra]CCEGLRCK LWCRKEI{Amide} |
| 1515 | CyA-[Nle6;hPra17;Glu28]JzTx-V(1-29) | {H}-[CyA]YCQKW[Nle]W TCDSKRACC[hPra]GLRCK LWCRKEI{Amide} |
| 1516 | BhPra-+[Nle6]JzTx-V(1-29) | {H}-[BhPra]YCQKW [Nle]WTCDSKRACCEGLRC KLWCRKII{Amide} |
| 1517 | CyA-[BhPra1;Nle6]JzTx-V(1-29) | {H}-[CyA][BhPra]CQKW [Nle]WTCDSKRACCEGLRC KLWCRKII{Amide} |
| 1518 | CyA-[Nle6;BhPra11]JzTx-V(1-29) | {H}-[CyA]YCQKW[Nle]W TCD[BhPra]KRACCEGLRC KLWCRKII{Amide} |
| 1519 | CyA-[Nle6;BhPra12]JzTx-V(1-29) | {H}-[CyA]YCQKW[Nle]W TCDS[BhPra]RACCEGLRC KLWCRKII{Amide} |
| 1520 | CyA-[Nle6;BhPra14]JzTx-V(1-29) | {H}-[CyA]YCQKW[Nle]W TCDSKR[BhPra]CCEGLRC KLWCRKII{Amide} |
| 1521 | CyA-[Nle6;BhPra17]JzTx-V(1-29) | {H}-[CyA]YCQKW[Nle]W TCDSKRACC[BhPra]GLRC KLWCRKII{Amide} |
| 1522 | BhPra-[Nle6;Glu28]JzTx-V(1-29) | {H}-[BhPra]YCQKW [Nle]WTCDSKRACCEGLRC KLWCRKEI{Amide} |
| 1523 | CyA-[BhPra1;Nle6;Glu28]JzTx-V(1-29) | {H}-[CyA][BhPra]CQKW [Nle]WTCDSKRACCEGLRC KLWCRKEI{Amide} |
| 1524 | CyA-[Nle6;BhPra11;Glu28]JzTx-V(1-29) | {H}-[CyA]YCQKW[Nle]W TCD[BhPra]KRACCEGLRC KLWCRKEI{Amide} |
| 1525 | CyA-[Nle6;BhPra12;Glu28]JzTx-V(1-29) | {H}-[CyA]YCQKW[Nle]W TCDS[BhPra]RACCEGLRC KLWCRKEI{Amide} |
| 1526 | CyA-[Nle6;BhPra14;Glu28]JzTx-V(1-29) | {H}-[CyA]YCQKW[Nle]W TCDSKR[BhPra]CCEGLRC KLWCRKEI{Amide} |
| 1527 | CyA-[Nle6;BhPra17;Glu28]JzTx-V(1-29) | {H}-[CyA]YCQKW[Nle]W TCDSKRACC[BhPra]GLRC KLWCRKEI{Amide} |
| 1528 | EPA-[Nle6]JzTx-V(1-29) | {H}-[EPA]YCQKW[Nle]W TCDSKRACCEGLRCKLWCRK II{Amide} |
| 1529 | CyA-[EPA1;Nle6]JzTx-V(1-29) | {H}-[CyA][EPA]CQKW [Nle]WTCDSKRACCEGLRC KLWCRKII{Amide} |
| 1530 | CyA-[Nle6;EPA11]JzTx-V(1-29) | {H}-[CyA]YCQKW[Nle]W TCD[EPA]KRACCEGLRCKL WCRKII{Amide} |
| 1531 | CyA-[Nle6;EPA12]JzTx-V(1-29) | {H}-[CyA]YCQKW[Nle]W TCDS[EPA]RACCEGLRCKL WCRKII{Amide} |

TABLE 5-continued

Amino acid sequences of JzTx-V and JzTx-V peptide analogs.

| SEQ ID NO. | Designation | Amino Acid Sequence |
|---|---|---|
| 1532 | CyA-[Nle6;EPA14]JzTx-V(1-29) | {H}-[CyA]YCQKW[Nle]WTCDSKR[EPA]CCEGLRCKLWCRKII{Amide} |
| 1533 | CyA-[Nle6;EPA17]JzTx-V(1-29) | {H}-[CyA]YCQKW[Nle]WTCDSKRACC[EPA]GLRCKLWCRKII{Amide} |
| 1534 | EPA-[Nle6;Glu28]JzTx-V(1-29) | {H}-[EPA]YCQKW[Nle]WTCDSKRACCEGLRCKLWCRKEI{Amide} |
| 1535 | CyA-[EPA1;Nle6;Glu28]JzTx-V(1-29) | {H}-[CyA][EPA]CQKW[Nle]WTCDSKRACCEGLRCKLWCRKEI{Amide} |
| 1536 | CyA-[Nle6;EPA11;Glu28]JzTx-V(1-29) | {H}-[CyA]YCQKW[Nle]WTCD[EPA]KRACCEGLRCKLWCRKEI{Amide} |
| 1537 | CyA-[Nle6;EPA12;Glu28]JzTx-V(1-29) | {H}-[CyA]YCQKW[Nle]WTCDS[EPA]RACCEGLRCKLWCRKEI{Amide} |
| 1538 | CyA-[Nle6;EPA14;Glu28]JzTx-V(1-29) | {H}-[CyA]YCQKW[Nle]WTCDSKR[EPA]CCEGLRCKLWCRKEI{Amide} |
| 1539 | CyA-[Nle6;EPA17;Glu28]JzTx-V(1-29) | {H}-[CyA]YCQKW[Nle]WTCDSKRACC[EPA]GLRCKLWCRKEI{Amide} |
| 1540 | Pra-[4-ClhF5;Nle6;Glu28]JzTx-V(1-29) | {H}-[Pra]YCQK[4-ClhF][Nle]WTCDSKRACCEGLRCKLWCRKEI{Amide} |
| 1541 | Pra-[4-FhF5;Nle6;Glu28]JzTx-V(1-29) | {H}-[Pra]YCQK[4-FhF][Nle]WTCDSKRACCEGLRCKLWCRKEI{Amide} |
| 1542 | Pra-[4-MehF5;Nle6;Glu28]JzTx-V(1-29) | {H}-[Pra]YCQK[4-MehF][Nle]WTCDSKRACCEGLRCKLWCRKEI{Amide} |
| 1543 | Pra-[4-MeOhF5;Nle6;Glu28]JzTx-V(1-29) | {H}-[Pra]YCQK[4-MeOhF][Nle]WTCDSKRACCEGLRCKLWCRKEI{Amide} |
| 1544 | Pra-[3-BrhF5;Nle6;Glu28]JzTx-V(1-29) | {H}-[Pra]YCQK[3-BrhF][Nle]WTCDSKRACCEGLRCKLWCRKEI{Amide} |
| 1545 | Pra-[3-ClhF5;Nle6;Glu28]JzTx-V(1-29) | {H}-[Pra]YCQK[3-ClhF][Nle]WTCDSKRACCEGLRCKLWCRKEI{Amide} |
| 1546 | Pra-[3-FhF5;Nle6;Glu28]JzTx-V(1-29) | {H}-[Pra]YCQK[3-FhF][Nle]WTCDSKRACCEGLRCKLWCRKEI{Amide} |
| 1547 | Pra-[3-MehF5;Nle6;Glu28]JzTx-V(1-29) | {H}-[Pra]YCQK[3-MehF][Nle]WTCDSKRACCEGLRCKLWCRKEI{Amide} |
| 1548 | Pra-[3-MeOhF5;Nle6;Glu28]JzTx-V(1-29) | {H}-[Pra]YCQK[3-MeOhF][Nle]WTCDSKRACCEGLRCKLWCRKEI{Amide} |
| 1549 | Pra-[2-BrhF5;Nle6;Glu28]JzTx-V(1-29) | {H}-[Pra]YCQK[2-BrhF][Nle]WTCDSKRACCEGLRCKLWCRKEI{Amide} |

TABLE 5-continued

Amino acid sequences of JzTx-V and JzTx-V peptide analogs.

| SEQ ID NO. | Designation | Amino Acid Sequence |
|---|---|---|
| 1550 | Pra-[2-ClhF5;Nle6;Glu28]JzTx-V(1-29) | {H}-[Pra]YCQK[2-ClhF] [Nle]WTCDSKRACCEGLRC KLWCRKEI{Amide} |
| 1551 | Pra-[2-FhF5;Nle6;Glu28]JzTx-V(1-29) | {H}-[Pra]YCQK[2-FhF] [Nle]WTCDSKRACCEGLRC KLWCRKEI{Amide} |
| 1552 | Pra-[2-MehF5;Nle6;Glu28]JzTx-V(1-29) | {H}-[Pra]YCQK[2-MehF] [Nle]WTCDSKRACCEGLRC KLWCRKEI{Amide} |
| 1553 | Pra-[2-MeOhF5;Nle6;Glu28]JzTx-V(1-29) | {H}-[Pra]YCQK [2-MeOhF][Nle]WTCDSK RACCEGLRCKLWCRKEI {Amide} |
| 1554 | Pra-[4-ClhF5;Nle6;Glu28;Cha29] JzTx-V(1-29) | {H}-[Pra]YCQK[4-ClhF] [Nle]WTCDSKRACCEGLRC KLWCRKE[Cha]{Amide} |
| 1555 | Pra-[4-FhF5;Nle6;Glu28;Cha29] JzTx-V(1-29) | {H}-[Pra]YCQK[4-FhF] [Nle]WTCDSKRACCEGLRC KLWCRKE[Cha]{Amide} |
| 1556 | Pra-[4-MehF5;Nle6;Glu28;Cha29] JzTx-V(1-29) | {H}-[Pra]YCQK[4-MehF] [Nle]WTCDSKRACCEGLRC KLWCRKE[Cha]{Amide} |
| 1557 | Pra-[4-MeOhF5;Nle6;Glu28;Cha29] JzTx-V(1-29) | {H}-[Pra]YCQK [4-MeOhF][Nle]WTCDSK RACCEGLRCKLWCRKE [Cha]{Amide} |
| 1558 | Pra-[3-BrhF5;Nle6;Glu28;Cha29] JzTx-V(1-29) | {H}-[Pra]YCQK[3-BrhF] [Nle]WTCDSKRACCEGLRC KLWCRKE[Cha]{Amide} |
| 1559 | Pra-[3-ClhF5;Nle6;Glu28;Cha29] JzTx-V(1-29) | {H}-[Pra]YCQK[3-ClhF] [Nle]WTCDSKRACCEGLRC KLWCRKE[Cha]{Amide} |
| 1560 | Pra-[3-FhF5;Nle6;Glu28;Cha29] JzTx-V(1-29) | {H}-[Pra]YCQK[3-FhF] [Nle]WTCDSKRACCEGLRC KLWCRKE[Cha]{Amide} |
| 1561 | Pra-[3-MehF5;Nle6;Glu28;Cha29] JzTx-V(1-29) | {H}-[Pra]YCQK[3-MehF] [Nle]WTCDSKRACCEGLRC KLWCRKE[Cha]{Amide} |
| 1562 | Pra-[3-MeOhF5;Nle6;Glu28;Cha29] JzTx-V(1-29) | {H}-[Pra]YCQK [3-MeOhF][Nle]WTCDSK RACCEGLRCKLWCRKE [Cha]{Amide} |
| 1563 | Pra-[2-BrhF5;Nle6;Glu28;Cha29] JzTx-V(1-29) | {H}-[Pra]YCQK[2-BrhF] [Nle]WTCDSKRACCEGLRC KLWCRKE[Cha]{Amide} |
| 1564 | Pra-[2-ClhF5;Nle6;Glu28;Cha29] JzTx-V(1-29) | {H}-[Pra]YCQK[2-ClhF] [Nle]WTCDSKRACCEGLRC KLWCRKE[Cha]{Amide} |
| 1565 | Pra-[2-FhF5;Nle6;Glu28;Cha29] JzTx-V(1-29) | {H}-[Pra]YCQK[2-FhF] [Nle]WTCDSKRACCEGLRC KLWCRKE[Cha]{Amide} |
| 1566 | Pra-[2-MehF5;Nle6;Glu28;Cha29] JzTx-V(1-29) | {H}-[Pra]YCQK[2-MehF] [Nle]WTCDSKRACCEGLRC KLWCRKE[Cha]{Amide} |

TABLE 5-continued

Amino acid sequences of JzTx-V and JzTx-V peptide analogs.

| SEQ ID NO. | Designation | Amino Acid Sequence |
|---|---|---|
| 1567 | Pra-[2-MeOhF5;Nle6;Glu28;Cha29] JzTx-V(1-29) | {H}-[Pra]YCQK [2-MeOhF][Nle]WTCDSK RACCEGLRCKLWCRKE [Cha]{Amide} |
| 1568 | CyA-[4-ClhF5;Nle6;Pra17;Glu28] JzTx-V(1-29) | {H}-[CyA]YCQK[4-ClhF] [Nle]WTCDSKRACC[Pra] GLRCKLWCRKEI{Amide} |
| 1569 | CyA-[4-FhF5;Nle6;Pra17;Glu28] JzTx-V(1-29) | {H}-[CyA]YCQK[4-FhF] [Nle]WTCDSKRACC[Pra] GLRCKLWCRKEI{Amide} |
| 1570 | CyA-[4-MehF5;Nle6;Pra17;Glu28] JzTx-V(1-29) | {H}-[CyA]YCQK[4-MehF] [Nle]WTCDSKRACC[Pra] GLRCKLWCRKEI{Amide} |
| 1571 | CyA-[4-MeOhF5;Nle6;Pra17;Glu28] JzTx-V(1-29) | {H}-[CyA]YCQK [4-MeOhF][Nle]WTCDSK RACC[Pra]GLRCKLWCRKE I{Amide} |
| 1572 | CyA-[3-BrhF5;Nle6;Pra17;Glu28] JzTx-V(1-29) | {H}-[CyA]YCQK[3-BrhF] [Nle]WTCDSKRACC[Pra] GLRCKLWCRKEI{Amide} |
| 1573 | CyA-[3-ClhF5;Nle6;Pra17;Glu28] JzTx-V(1-29) | {H}-[CyA]YCQK[3-ClhF] [Nle]WTCDSKRACC[Pra] GLRCKLWCRKEI{Amide} |
| 1574 | CyA-[3-FhF5;Nle6;Pra17;Glu28] JzTx-V(1-29) | {H}-[CyA]YCQK[3-FhF] [Nle]WTCDSKRACC[Pra] GLRCKLWCRKEI {Amide} |
| 1575 | CyA-[3-MehF5;Nle6;Pra17;Glu28] JzTx-V(1-29) | {H}-[CyA]YCQK[3-MehF] [Nle]WTCDSKRACC[Pra] GLRCKLWCRKEI{Amide} |
| 1576 | CyA-[3-MeOhF5;Nle6;Pra17;Glu28] JzTx-V(1-29) | {H}-[CyA]YCQK [3-MeOhF][Nle]WTCDSK RACC[Pra]GLRCKLWCRKE I{Amide} |
| 1577 | CyA-[2-BrhF5;Nle6;Pra17;Glu28] JzTx-V(1-29) | {H}-[CyA]YCQK[2-BrhF] [Nle]WTCDSKRACC[Pra] GLRCKLWCRKEI{Amide} |
| 1578 | CyA-[2-ClhF5;Nle6;Pra17;Glu28] JzTx-V(1-29) | {H}-[CyA]YCQK[2-ClhF] [Nle]WTCDSKRACC[Pra] GLRCKLWCRKEI{Amide} |
| 1579 | CyA-[2-FhF5;Nle6;Pra17;Glu28] JzTx-V(1-29) | {H}-[CyA]YCQK[2-FhF] [Nle]WTCDSKRACC[Pra] GLRCKLWCRKEI{Amide} |
| 1580 | CyA-[2-MehF5;Nle6;Pra17;Glu28] JzTx-V(1-29) | {H}-[CyA]YCQK[2-MehF] [Nle]WTCDSKRACC[Pra] GLRCKLWCRKEI{Amide} |
| 1581 | CyA-[2-MeOhF5;Nle6;Pra17;Glu28] JzTx-V(1-29) | {H}-[CyA]YCQK [2-MeOhF][Nle]WTCDSK RACC[Pra]GLRCKLWCRKE I{Amide} |
| 1582 | CyA-[4-ClhF5;Nle6;Pra17;Glu28; Cha29]JzTx-V(1-29) | {H}-[CyA]YCQK[4-ClhF] [Nle]WTCDSKRACC[Pra] GLRCKLWCRKE[Cha] {Amide} |
| 1583 | CyA-[4-FhF5;Nle6;Pra17;Glu28; Cha29]JzTx-V(1-29) | {H}-[CyA]YCQK[4-FhF] [Nle]WTCDSKRACC[Pra] GLRCKLWCRKE[Cha] {Amide} |

TABLE 5-continued

Amino acid sequences of JzTx-V and JzTx-V peptide analogs.

| SEQ ID NO. | Designation | Amino Acid Sequence |
|---|---|---|
| 1584 | CyA-[4-MehF5;Nle6;Pra17;Glu28; Cha29]JzTx-V(1-29) | {H}-[CyA]YCQK[4-MehF][Nle]WTCDSKRACC[Pra]GLRCKLWCRKE[Cha]{Amide} |
| 1585 | CyA-[4-MeOhF5;Nle6;Pra17;Glu28; Cha29]JzTx-V(1-29) | {H}-[CyA]YCQK[4-MeOhF][Nle]WTCDSKRACC[Pra]GLRCKLWCRKE[Cha]{Amide} |
| 1586 | CyA-[3-BrhF5;Nle6;Pra17;Glu28; Cha29]JzTx-V(1-29) | {H}-[CyA]YCQK[3-BrhF][Nle]WTCDSKRACC[Pra]GLRCKLWCRKE[Cha]{Amide} |
| 1587 | CyA-[3-ClhF5;Nle6;Pra17;Glu28; Cha29]JzTx-V(1-29) | {H}-[CyA]YCQK[3-ClhF][Nle]WTCDSKRACC[Pra]GLRCKLWCRKE[Cha]{Amide} |
| 1588 | CyA-[3-FhF5;Nle6;Pra17;Glu28; Cha29]JzTx-V(1-29) | {H}-[CyA]YCQK[3-FhF][Nle]WTCDSKRACC[Pra]GLRCKLWCRKE[Cha]{Amide} |
| 1589 | CyA-[3-MehF5;Nle6;Pra17;Glu28; Cha29]JzTx-V(1-29) | {H}-[CyA]YCQK[3-MehF][Nle]WTCDSKRACC[Pra]GLRCKLWCRKE[Cha]{Amide} |
| 1590 | CyA-[3-MeOhF5;Nle6;Pra17;Glu28; Cha29]JzTx-V(1-29) | {H}-[CyA]YCQK[3-MeOhF][Nle]WTCDSKRACC[Pra]GLRCKLWCRKE[Cha]{Amide} |
| 1591 | CyA-[2-BrhF5;Nle6;Pra17;Glu28; Cha29]JzTx-V(1-29) | {H}-[CyA]YCQK[2-BrhF][Nle]WTCDSKRACC[Pra]GLRCKLWCRKE[Cha]{Amide} |
| 1592 | CyA-[2-ClhF5;Nle6;Pra17;Glu28; Cha29]JzTx-V(1-29) | {H}-[CyA]YCQK[2-ClhF][Nle]WTCDSKRACC[Pra]GLRCKLWCRKE[Cha]{Amide} |
| 1593 | CyA-[2-FhF5;Nle6;Pra17;Glu28; Cha29]JzTx-V(1-29) | {H}-[CyA]YCQK[2-FhF][Nle]WTCDSKRACC[Pra]GLRCKLWCRKE[Cha]{Amide} |
| 1594 | CyA-[2-MehF5;Nle6;Pra17;Glu28; Cha29]JzTx-V(1-29) | {H}-[CyA]YCQK[2-MehF][Nle]WTCDSKRACC[Pra]GLRCKLWCRKE[Cha]{Amide} |
| 1595 | CyA-[2-MeOhF5;Nle6;Pra17;Glu28; Cha29]JzTx-V(1-29) | {H}-[CyA]YCQK[2-MeOhF][Nle]WTCDSKRACC[Pra]GLRCKLWCRKE[Cha]{Amide} |
| 1596 | Pra-[Glu1,14,28;hPhe5;Nle6] JzTx-V(1-29) | {H}-[Pra]ECQK[hPhe][Nle]WTCDSKRECCEGLRCKLWCRKEI{Amide} |
| 1597 | Pra-[Glu1,14,28;Nle6;Cha29] JzTx-V(1-29) | {H}-[Pra]ECQKW[Nle]WTCDSKRECCEGLRCKLWCRKE[Cha]{Amide} |
| 1598 | Pra-[Glu1,14,28;hPhe5;Nle6; Cha29]JzTx-V(1-29) | {H}-[Pra]ECQK[hPhe][Nle]WTCDSKRECCEGLRCKLWCRKE[Cha]{Amide} |

TABLE 5-continued

Amino acid sequences of JzTx-V and JzTx-V peptide analogs.

| SEQ ID NO. | Designation | Amino Acid Sequence |
|---|---|---|
| 1599 | Glu-[Pra1;hPhe5;Nle6;Glu11,28] JzTx-V(1-29) | {H}-E[Pra]CQK[hPhe] [Nle]WTCDEKRACCEGLRC KLWCRKEI{Amide} |
| 1600 | Glu-[Pra1;hPhe5;Nle6;Glu14,28] JzTx-V(1-29) | {H}-E[Pra]CQK[hPhe] [Nle]WTCDSKRECCEGLRC KLWCRKEI{Amide} |
| 1601 | Glu-[Pra1;hPhe5;Nle6;Glu11,28; Cha29]JzTx-V(1-29) | {H}-E[Pra]CQK[hPhe] [Nle]WTCDEKRACCEGLRC KLWCRKE[Cha]{Amide} |
| 1602 | Glu-[Pra1;hPhe5;Nle6;Glu14,28; Cha29]JzTx-V(1-29) | {H}-E[Pra]CQK[hPhe] [Nle]WTCDSKRECCEGLRC KLWCRKE[Cha]{Amide} |
| 1603 | Pra-[4-BrhF5;Nle6;Glu28] JzTx-V(1-29) | {H}-[Pra]YCQK[4-BrhF] [Nle]WTCDSKRACCEGLRC KLWCRKEI{Amide} |
| 1604 | Pra-[4-BrhF5;Nle6;Glu28;Cha29] JzTx-V(1-29) | {H}-[Pra]YCQK[4-BrhF] [Nle]WTCDSKRACCEGLRC KLWCRKE[Cha]{Amide} |
| 1605 | CyA-[4-BrhF5;Nle6;Pra17;Glu28] JzTx-V(1-29) | {H}-[CyA]YCQK[4-BrhF] [Nle]WTCDSKRACC[Pra] GLRCKLWCRKEI{Amide} |
| 1606 | CyA-[4-BrhF5;Nle6;Pra17;Glu28; Cha29]JzTx-V(1-29) | {H}-[CyA]YCQK[4-BrhF] [Nle]WTCDSKRACC[Pra] GLRCKLWCRKE[Cha] {Amide} |
| 1607 | CyA-[Nle6;Pra17;4tBu-F24;Glu28] JzTx-V(1-29) | {H}-[CyA]YCQKW[Nle]W TCDSKRACC[Pra]GLRCKL [4tBu-F]CRKEI{Amide} |
| 1608 | Pra-[Nle6;4tBu-F24;Glu28]JzTx-V(1-29) | {H}-[Pra]YCQKW[Nle]W TCDSKRACCEGLRCKL [4tBu-PF]CRKEI{Amide} |
| 1609 | Pra-[Nle6;6-BrW24;Glu28]JzTx-V(1-29) | {H}-[Pra]YCQKW[Nle]W TCDSKRACCEGLRCKL [6-BrW]CRKEI{Amide} |
| 1610 | Pra-[Nle6;6-MeW24;Glu28]JzTx-V(1-29) | {H}-[Pra]YCQKW[Nle]W TCDSKRACCEGLRCKL [6-MeW]CRKEI{Amide} |
| 1611 | Pra-[Nle6;7-BrW24;Glu28]JzTx-V(1-29) | {H}-[Pra]YCQKW[Nle]W TCDSKRACCEGLRCKL [7-BrW]CRKEI{Amide} |
| 1612 | Pra-[Nle6;Phe29]JzTx-V(1-29) | {H}-[Pra]YCQKW[Nle]W TCDSKRACCEGLRCKLWCRK IF{Amide} |
| 1613 | Pra-[Nle6;hPhe29]JzTx-V(1-29) | {H}-[Pra]YCQKW[Nle]W TCDSKRACCEGLRCKLWCRK I[hPhe]{Amide} |
| 1614 | Pra-[Nle6;4-Me-F29]JzTx-V(1-29) | {H}-[Pra]YCQKW[Nle]W TCDSKRACCEGLRCKLWCRK I[4-Me-F]{Amide} |
| 1615 | CyA-[Nle6;Pra17;Glu28;4-Me-F29] JzTx-V(1-29) | {H}-[CyA]YCQKW[Nle]W TCDSKRACC[Pra]GLRCKL WCRKE[4-Me-F]{Amide} |
| 1616 | CyA-[Nle6;Pra17;Cit20;5-BrW24; Glu28]JzTx-V(1-29) | {H}-[CyA]YCQKW[Nle]W TCDSKRACC[Pra]GL [Cit]CKL[5-BrW]CRKEI {Amide} |

TABLE 5-continued

Amino acid sequences of JzTx-V and JzTx-V peptide analogs.

| SEQ ID NO. | Designation | Amino Acid Sequence |
|---|---|---|
| 1617 | CyA-[Nle6;Pra17;Cit20;BrW24; Glu28]JzTx-V(1-26;5-29)-Gly-FreeAcid | {H}-[CyA]YCQKW[Nle]W TCDSKRACC[Pra]GL [Cit]CKL[5-BrW]C [Cit]KEIG{FreeAcid} |
| 1618 | Glu-[Nle6;Pra17;Cit26;Glu28] JzTx-V(1-29)-Gly-FreeAcid | {H}-EYCQKW[Nle]WTCDS KRACC[Pra]GLRCKLWC [Cit]KEIG{FreeAcid} |
| 1619 | Glu-Nva-[Nle6;Pra17;5-BrW24; Glu28]JzTx-V(1-29) | {H}-E[Nva]YCQKW[Nle] WTCDSKRACC[Pra]GLRCK L[5-BrW]CRKEI{Amide} |
| 1620 | Glu-Nva-[Nle6;Pra11;Glu28] JzTx-V(1-29) | {H}-E[Nva]YCQKW[Nle] WTCD[Pra]KRACCEGLRCK LWCRKEI{Amide} |
| 1621 | Glu-Nva-[Nle6;Pra11;5-BrW24; Glu28]JzTx-V(1-29) | {H}-E[Nva]YCQKW[Nle] WTCD[Pra]KRACCEGLRCK L[5-BrW]CRKEI{Amide} |
| 1622 | Glu-Nva-[Nle6;Pra11;5-BrW24;Glu28; Trp29]JzTx-V(1-29) | {H}-E[Nva]YCQKW[Nle] WTCD[Pra]KRACCEGLRCK L[5-BrW]CRKEW{Amide} |
| 1623 | Glu-Nva-[Nle6;Pra11;5-BrW24;Glu28; 4tBu-F29]JzTx-V(1-29) | {H}-E[Nva]YCQKW[Nle] WTCD[Pra]KRACCEGLRCK L[5-BrW]CRKE[4tBu-F] {Amide} |
| 1624 | CyA-[Nle6;Pra11;5-BrW24;Glu28] JzTx-V(1-29) | {H}-[CyA]YCQKW[Nle]W TCD[Pra]KRACCEGLRCKL [5-BrW]CRKEI{Amide} |
| 1625 | CyA-[Nle6;Pra11;4tBu-F24;Glu28] JzTx-V(1-29) | {H}-[CyA]YCQKW[Nle]W TCD[Pra]KRACCEGLRCKL [4tBu-F]CRKEI{Amide} |
| 1626 | CyA-[Nle6;Pra11;Glu12;5-BrW24] JzTx-V(1-29) | {H}-[CyA]YCQKW[Nle]W TCD[Pra]ERACCEGLRCKL [5-BrW]CRKII{Amide} |
| 1627 | Nva-[Nle6;Pra11;Glu28]JzTx-V(1-29) | {H}-[Nva]YCQKW[Nle]W TCD[Pra]KRACCEGLRCKL WCRKEI{Amide} |
| 1628 | Nva-[Nle6;Pra11;Glu12,28] JzTx-V(1-29) | {H}-[Nva]YCQKW[Nle]W TCD[Pra]ERACCEGLRCKL WCRKEI{Amide} |
| 1629 | CyA-[Nle6;Pra11;Glu12,28; 5-BrW24]JzTx-V(1-29) | {H}-[CyA]YCQKW[Nle]W TCD[Pra]ERACCEGLRCKL [5-BrW]CRKEI{Amide} |
| 1630 | CyA-[Nle6;Pra17;5-BrW24;Glu28] JzTx-V(1-29)-Gly-FreeAcid | {H}-[CyA]YCQKW[Nle]W TCDSKRACC[Pra]GLRCKL [5-BrW]CRKEIG {FreeAcid} |
| 1631 | CyA-[Nle6;Pra17;5-BrW24;Glu28] JzTx-V(1-29)-Gly-Glu-FreeAcid | {H}-[CyA]YCQKW[Nle]W TCDSKRACC[Pra]GLRCKL [5-BrW]CRKEIGE {FreeAcid} |
| 1632 | CyA-[Nle6;Pra17;Cit20;Glu28] JzTx-V(1-29) | {H}-[CyA]YCQKW[Nle]W TCDSKRACC[Pra]GL [Cit]CKLWCRKEI {Amide} |
| 1633 | CyA-[Nle6;Pra17;Cit20,26;Glu28] JzTx-V(1-29) | {H}-[CyA]YCQKW[Nle]W TCDSKRACC[Pra]GL [Cit]CKLWC[Cit]KEI {Amide} |

TABLE 5-continued

Amino acid sequences of JzTx-V and JzTx-V peptide analogs.

| SEQ ID NO. | Designation | Amino Acid Sequence |
|---|---|---|
| 1634 | CyA-[Nle6;Pra17;5-BrW24;Cit26; Glu28]JzTx-V(1-29) | {H}-[CyA]YCQKW[Nle]W TCDSKRACC[Pra]GLRCKL [5-BrW]C[Cit]KEI {Amide} |
| 1635 | Pra-[Nle6;5-BrW24;Glu28;Phe29] JzTx-V(1-29)-Gly-Glu-FreeAcid | {H}-[Pra]YCQKW[Nle]W TCDSKRACCEGLRCKL [5-BrW]CRKEFGE {FreeAcid} |
| 1636 | Nva-[hPhe5;Nle6;Glu11,28;Pra17; 5-BrW24]JzTx-V(1-29) | {H}-[Nva]YCQK[hPhe] [Nle]WTCDEKRACC[Pra] GLRCKL[5-BrW]CRKEI {Amide} |
| 1637 | Nva-[hPhe5;Nle6;Pra17;5-BrW24; Glu28]JzTx-V(1-29) | {H}-[Nva]YCQK[hPhe] [Nle]WTCDSKRACC[Pra] GLRCKL[5-BrW]CRKEI {Amide} |
| 1638 | Nva-[hPhe5;Nle6;Pra11;5-BrW24; Glu28]JzTx-V(1-29) | {H}-[Nva]YCQK[hPhe] [Nle]WTCD[Pra]KRACCE GLRCKL [5-BrW]CRKEI {Amide} |
| 1639 | Nva-[4-Cl-F5;Nle6;Pra11;5-BrW24; Glu28]JzTx-V(1-29) | {H}-[NvA]YCQK [4-Cl-F][Nle]WTCD [Pra]KRACCEGLRCKL [5-BrW]CRKEI {Amide} |
| 1640 | Nva-[4-Cl-F5;Nle6;Pra11;Glu28] JzTx-V(1-29) | {H}-[Nva]YCQK [4-Cl-F][Nle]WTCD [Pra]KRACCEGLRCKLWCR KEI{Amide} |
| 1641 | CyA-[hPhe5;Nle6;Pra17;Glu27,28] JzTx-V(1-29) | {H}-[CyA]YCQK[hPhe] [Nle]WTCDSKRACC[Pra] GLRCKLWCREEI{Amide} |
| 1642 | Pra-[Nle6;Glu12;Gln27]JzTx-V(1-29) | {H}-[Pra]YCQKW[Nle]W TCDSERACCEGLRCKLWCRQ II{Amide} |
| 1643 | Glu-[Nva1;Nle6;Pra11;5-BrW24; Glu27,28]JzTx-V(1-29) | {H}-E[Nva]CQKW[Nle]W TCD[Pra]KRACCEGLRCKL [5-BrW]CREEI{Amide} |
| 1644 | Pra-[Nle6;Glu28;Phe29] JzTx-V(1-29)-Gly-FreeAcid | {H}-[Pra]YCQKW[Nle]W TCDSKRACCEGLRCKLWCRK EFG{FreeAcid} |
| 1645 | Nva-[hPhe5;Nle6;Glu14,28;Pra17] JzTx-V(1-29) | {H}-[Nva]YCQK[hPhe] [Nle]WTCDSKRECC[Pra] GLRCKLWCRKEI{Amide} |
| 1646 | Glu-[Nva1;Nle6;Pra17;Glu27] JzTx-V(1-29)-Gly-FreeAcid | {H}-E[Nva]CQKW[Nle]W TCDSKRACC[Pra]GLRCKL WCREIIG{FreeAcid} |
| 1647 | Glu-[Nva1;Nle6;Pra17;Gln27;Glu28] JzTx-V(1-29)-Gly-FreeAcid | {H}-E[Nva]CQKW[Nle]W TCDSKRACC[Pra]GLRCKL WCRQEIG{FreeAcid} |
| 1648 | CyA-[Nle6;Glu12;Pra17;Gln27] JzTx-V(1-29) | {H}-[CyA]YCQKW[Nle]W TCDSERACC[Pra]GLRCKL WCRQII{Amide} |
| 1649 | Pra-[hPhe5;Nle6;5-BrW24;Glu28; Phe29]JzTx-V(1-29) | {H}-[Pra]YCQK[hPhe] [Nle]WTCDSKRACCEGLRC KL[5-BrW]CRKEF {Amide} |

TABLE 5-continued

Amino acid sequences of JzTx-V and JzTx-V peptide analogs.

| SEQ ID NO. | Designation | Amino Acid Sequence |
|---|---|---|
| 1650 | CyA-[hPhe5;Nle6;Pra11;5-BrW24; Glu28;Phe29]JzTx-V(1-29) | {H}-[CyA]YCQK[hPhe] [Nle]WTCD[Pra]KRACCE GLRCKL[5-BrW]CRKEF {Amide} |
| 1651 | Glu-[hPhe5;Nle6;5-BrW24;Glu28; Phe29]JzTx-V(1-29) | {H}-EYCQK[hPhe][Nle] WTCDSKRACC[Pra]GLRCK L[5-BrW]CRKEF{Amide} |
| 1652 | CyA-[Nle6;Pra17;Chg23;5-BrW24; Glu28]JzTx-V(1-29) | {H}-[CyA]YCQKW[Nle]W TCDSKRACC[Pra]GLRCK [Chg][5-BrW]CRKEI {Amide} |
| 1653 | Glu-[hPhe5;Nle6;Pra11;Chg23; Glu28;Phe29]JzTx-V(1-29) | {H}-EYCQK[hPhe][Nle] WTCD[Pra]KRACCEGLRCK [Chg]WCRKEF{Amide} |
| 1654 | Pra-[Nle6;Glu11,28;Chg23;Phe29] JzTx-V(1-29)-Gly-FreeAcid | {H}-[Pra]YCQKW[Nle]W TCDEKRACCEGLRCK[Chg] WCRKEFG{FreeAcid} |
| 1655 | Pra-[Nle6;Cit20;Chg23;Glu28] JzTx-V(1-29) | {H}-[Pra]YCQKW[Nle]W TCDSKRACCEGL[Cit]CK [Chg]WCRKEI{Amide} |
| 1656 | Glu-[Nle6;Pra17;Cit20;Chg23; Glu28]JzTx-V(1-29) | {H}-EYCQKW[Nle]WTCDS KRACC[Pra]GL[Cit]CK [Chg]WCRKEI{Amide} |
| 1657 | CyA-[Glu1,28;Nle6;Pra11;Chg23; 5-BrW24]JzTx-V(1-29) | {H}-[CyA]ECQKW[Nle]W TCD[Pra]KRACCEGLRCK [Chg][5-BrW]CRKEI {Amide} |
| 1658 | CyA-[Glu1,11,28;Nle6;Pra17; 5-BrW24]JzTx-V(1-29) | {H}-[CyA]ECQKW[Nle]W TCDEKRACC[Pra]GLRCKL [5-BrW]CRKEI{Amide} |
| 1659 | Nva-[hPhe5;Nle6;Glu11,28;Pra17; Cit20;Chg23;5-BrW24;Phe29] JzTx-V(1-29) | {H}-[Nva]YCQK[hPhe] [Nle]WTCDEKRACC[Pra] GL[Cit]CK[Chg] [5-BrW]CRKEF{Amide} |
| 1660 | Pra-[hPhe5;Nle6;Glu11,28;Cit20; Chg23;5-BrW24;Phe29]JzTx-V(1-29) | {H}-[Pra]YCQK[hPhe] [Nle]WTCDEKRACCEGL [Cit]CK[Chg][5-BrW]C RKEF{Amide} |
| 1661 | Nva-[hPhe5;Nle6;Glu14;Pra17; 5-BrW24;Phe29]JzTx-V(1-29) | {H}-[Nva]YCQK[hPhe] [Nle]WTCDSKRECC[Pra] GLRCKL[5-BrW]CRKIF {Amide} |
| 1662 | CyA-[Nle6;Pra17;5-MeW24;Glu28] JzTx-V(1-29) | {H}-[CyA]YCQKW[Nle]W TCDSKRACC[Pra]GLRCKL [5-MeW]CRKEI{Amide} |
| 1663 | Pra-[Nle6;5-MeW24;Glu28]JzTx-V(1-29) | {H}-[Pra]YCQKW[Nle]W TCDSKRACCEGLRCKL [5-MeW]CRKEI{Amide} |
| 1664 | [Nle6;Pra11;5-MeW24;Glu28]JzTx-V(1-29) | {H}-YCQKW[Nle]WTCD [Pra]KRACCEGLRCKL [5-MeW]CRKEI{Amide} |
| 1665 | CyA-[Nle6;Pra17;DiCl-F24;Glu28] JzTx-V(1-29) | {H}-[CyA]YCQKW[Nle]W TCDSKRACC[Pra]GLRCKL [DiCl-F]CRKEI{Amide} |
| 1666 | Pra-[Nle6;DiCl-F24;Glu28]JzTx-V(1-29) | {H}-[Pra]YCQKW[Nle]W TCDSKRACCEGLRCKL [DiCl-F]CRKEI{Amide} |

TABLE 5-continued

Amino acid sequences of JzTx-V and JzTx-V peptide analogs.

| SEQ ID NO. | Designation | Amino Acid Sequence |
|---|---|---|
| 1667 | CyA-[Nle6;Ala9,21;Pra17;Glu28] JzTx-V(1-29) | {H}-[CyA]YCQKW[Nle]W TADSKRACC[Pra]GLRAKL WCRKEI{Amide} |
| 1668 | Pra-[Nle6;5-ClW24;Glu28]JzTx-V(1-29) | {H}-[Pra]YCQKW[Nle]W TCDSKRACCEGLRCKL [5-ClW]CRKEI{Amide} |
| 1669 | Pra-[Nle6;pI-Phe24;Glu28]JzTx-V(1-29) | {H}-[Pra]YCQKW[Nle]W TCDSKRACCEGLRCKL [pI-Phe]CRKEI{Amide} |
| 1670 | CyA-[Nle6;Pra17;5-ClW24;Glu28] JzTx-V(1-29) | {H}-[CyA]YCQKW[Nle]W TCDSKRACC[Pra]GLRCKL [5-ClW]CRKEI{Amide} |
| 1671 | CyA-[Nle6;Pra17;pI-Phe24;Glu28] JzTx-V(1-29) | {H}-[CyA]YCQKW[Nle]W TCDSKRACC[Pra]GLRCKL [pI-Phe]CRKEI{Amide} |
| 1672 | [CyA1;Nle6;Glu11,28;Pra17]JzTx-V(1-29) | {H}-[CyA]CQKW[Nle]WT CDEKRACC[Pra]GLRCKLW CRKEI{Amide} |
| 1673 | [CyA1;Nle6;Glu11,12,28;Pra17] JzTx-V(1-29) | {H}-[CyA]CQKW[Nle]WT CDEERACC[Pra]GLRCKLW CRKEI{Amide} |
| 1674 | [CyA1;Nle6;Glu11,12,28;Pra17;Val20] JzTx-V(1-29) | {H}-[CyA]CQKW[Nle]WT CDEERACC[Pra]GLVCKLW CRKEI{Amide} |
| 1675 | [CyA1;Nle6;Ala12;Pra17;Glu28] JzTx-V(1-29) | {H}-[CyA]CQKW[Nle]WT CDSARACC[Pra]GLRCKLW CRKEI{Amide} |
| 1676 | [CyA1;Nle6;Pra17;Asp18;Glu28] JzTx-V(1-29) | {H}-[CyA]CQKW[Nle]WT CDSKRACC[Pra]DLRCKLW CRKEI{Amide} |
| 1677 | [CyA1;Nle6;Glu12,28;Pra17;Asp18] JzTx-V(1-29) | {H}-[CyA]CQKW[Nle]WT CDSERACC[Pra]DLRCKLW CRKEI{Amide} |
| 1678 | [CyA1;Nle6;Glu12,28;Pra17;Asp18;Val20] JzTx-V(1-29) | {H}-[CyA]CQKW[Nle]WT CDSERACC[Pra]DLVCKLW CRKEI{Amide} |
| 1679 | [CyA1;Nle6;Pra17;Val20;Glu28] JzTx-V(1-29) | {H}-[CyA]CQKW[Nle]WT CDSKRACC[Pra]GLVCKLW CRKEI{Amide} |
| 1680 | [CyA1;Nle6;Pra17;Gln22;Glu28] JzTx-V(1-29) | {H}-[CyA]CQKW[Nle]WT CDSKRACC[Pra]GLRCQLW CRKEI{Amide} |
| 1681 | [CyA1;Nle6;Pra17;Tyr27;Glu28] JzTx-V(1-29) | {H}-[CyA]CQKW[Nle]WT CDSKRACC[Pra]GLRCKLW CRYEI{Amide} |
| 1682 | [CyA1;Nle6;Pra17;Leu27;Glu28] JzTx-V(1-29) | {H}-[CyA]CQKW[Nle]WT CDSKRACC[Pra]GLRCKLW CRLEI{Amide} |
| 1683 | [Pra1;Nle6;Glu11,12,28;Val20] JzTx-V(1-29) | {H}-[Pra]CQKW[Nle]WT CDEERACCEGLVCKLWCRKE I{Amide} |
| 1684 | [Pra1;Nle6;Ala12;Glu28]JzTx-V(1-29) | {H}-[Pra]CQKW[Nle]WT CDSARACCEGLRCKLWCRKE I{Amide} |

TABLE 5-continued

Amino acid sequences of JzTx-V and JzTx-V peptide analogs.

| SEQ ID NO. | Designation | Amino Acid Sequence |
|---|---|---|
| 1685 | [Pra1;Nle6;Asp18;Glu28]JzTx-V(1-29) | {H}-[Pra]CQKW[Nle]WT CDSKRACCEDLRCKLWCRKE I{Amide} |
| 1686 | [Pra1;Nle6;Glu12,28;Asp18]JzTx-V(1-29) | {H}-[Pra]CQKW[Nle]WT CDSERACCEDLRCKLWCRKE I{Amide} |
| 1687 | [Pra1;Nle6;Glu12,28;Asp18;Val20] JzTx-V(1-29) | {H}-[Pra]CQKW[Nle]WT CDSERACCEDLVCKLWCRKE I{Amide} |
| 1688 | [Pra1;Nle6;Val20;Glu28]JzTx-V(1-29) | {H}-[Pra]CQKW[Nle]WT CDSKRACCEGLVCKLWCRKE I{Amide} |
| 1689 | [Pra1;Nle6;Tyr27;Glu28]JzTx-V(1-29) | {H}-[Pra]CQKW[Nle]WT CDSKRACCEGLRCKLWCRYE I{Amide} |
| 1690 | [Pra1;Nle6;Leu27;Glu28]JzTx-V(1-29) | {H}-[Pra]CQKW[Nle]WT CDSKRACCEGLRCKLWCRLE I{Amide} |
| 1691 | [CyA1;Nle6;Glu11,12 ;Pra17;Val20] JzTx-V(1-29) | {H}-[CyA]CQKW[Nle]WT CDEERACC[Pra]GLVCKLW CRKII{Amide} |
| 1692 | CyA-[Nle6,Atz(GGS-Br)17,Glu28] JzTx-V(1-29) | {H}-[CyA]YCQKW[Nle]W TCDSKRACC[Pra] ({Bromoacetyl}GGS [Aha]{Amide})GLRCKLW CRKEI{Amide} |
| 1693 | Atz-[Nle6;5-BrW24;Glu28]JzTx-V(1-29) | {H}-[Atz]YCQKW[Nle]W TCDSKRACCEGLRCKL [5-BrW]CRKEI{Amide} |
| 1694 | Glu-[Atz1;Nle6;Glu14,28]JzTx-V(1-29) | {H}-E[Atz]CQKW[Nle]W TCDSKRECCEGLRCKLWCRK EI{Amide} |

{H}- = amino group of N-terminal;
-{Amide} or {Amide} = amidated C-terminal;
Ac- = acetylated N-terminal;
-{Free Acid} = carboxylated C-terminal;
{biotin- = biotinylated N-terminal;
{4-Pen- = 4-pentynoylated N-terminal;
{bromoacetamide-PEG11-triazole}- = 3-1(1-(1-brom-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

As stated herein above, in accordance with the present invention, the peptide portions of the inventive composition of matter can also be chemically derivatized at one or more amino acid residues by known organic chemistry techniques. "Chemical derivative" or "chemically derivatized" refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine maybe substituted for lysine; 3-methylhistidine may be substituted for histidine; homoserine may be substituted for serine; and ornithine may be substituted for lysine.

Useful derivatizations include, in some embodiments, those in which the amino terminal of the peptide is chemically blocked so that conjugation with the vehicle will be prevented from taking place at an N-terminal free amino group. There may also be other beneficial effects of such a modification, for example a reduction in the toxin peptide analog's susceptibility to enzymatic proteolysis. The N-terminus can be acylated or modified to a substituted amine, or derivatized with another functional group, such as an aromatic moiety (e.g., an indole acid, benzyl (Bzl or Bn), dibenzyl (DiBzl or $Bn_2$), or benzyloxycarbonyl (Cbz or Z)), N,N-dimethylglycine or creatine. For example, in some embodiments, an acyl moiety, such as, but not limited to, a formyl, acetyl (Ac), propanoyl, butanyl, heptanyl, hexanoyl, octanoyl, or nonanoyl, can be covalently linked to the N-terminal end of the peptide, which can prevent undesired side reactions during conjugation of the vehicle to the peptide. Other exemplary N-terminal derivative groups include —$NRR^1$ (other than —$NH_2$), —$NRC(O)R^1$, —NRC(O)$OR^1$, —$NRS(O)_2R^1$, —$NHC(O)NHR^1$, succinimide, or benzyloxycarbonyl-NH-(Cbz-NH—), wherein R and $R^1$ are each independently hydrogen or lower alkyl and wherein the phenyl ring may be substituted with 1 to 3 substituents selected from $C_1$-$C_4$ alkyl, $C_1$-$C_4$ alkoxy, chloro, and bromo.

In some embodiments, one or more peptidyl [—C(O)NR-] linkages (bonds) between amino acid residues can be replaced by a non-peptidyl linkage. Exemplary non-peptidyl linkages are —$CH_2$-carbamate [—$CH_2$—OC(O)NR—], phosphonate, —$CH_2$-sulfonamide [—$CH_2$—$S(O)_2NR$—], urea [—NHC(O)NH—], —$CH_2$-secondary amine, and alkylated peptide [—$C(O)NR^6$— wherein $R^6$ is lower alkyl].

In some embodiments, one or more individual amino acid residues can be derivatized. Various derivatizing agents are known to react specifically with selected sidechains or terminal residues, as described in detail below by way of example.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N═C═N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. (See, e.g., Bhatnagar et al., J. Med. Chem., 39:3814-3819 (1996)).

Derivatization with bifunctional agents is useful for cross-linking the peptides or their functional derivatives to a water-insoluble support matrix, if desired, or to other macromolecular vehicles. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming cross-links in the presence of light. Alternatively, reactive water-insoluble matrices such as cyanogen bromide-activated carbohydrates and the reactive substrates, e.g., as described in U.S. Pat. Nos. 3,969,287; 3,691,016; 4,195,128; 4,247,642; 4,229,537; and 4,330,440, are employed for protein immobilization.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties (W. H. Freeman & Co., San Francisco), 79-86 (1983).

The above examples of derivatizations are not intended to be an exhaustive treatment, but merely illustrative.

The production of the composition of matter can also involve suitable protein purification techniques, when applicable. In some embodiments of the composition of matter of the invention, the molecule can be prepared to include a suitable isotopic label (e.g., $^{125}I$, $^{14}C$, $^{13}C$, $^{35}S$, $^{3}H$, $^{2}H$, $^{13}N$, $^{15}N$, $^{18}O$, $^{17}O$, etc.), for ease of quantification or detection.

Half-Life Extending Moieties.

Optionally, for modulation of the pharmacokinetic profile of the molecule to fit the therapeutic need, the composition of the present invention can include one or more half-life extending moieties of various masses and configurations, which half-life extending moiety, or moieties, can be covalently fused, attached, linked or conjugated to the toxin peptide analog. A "half-life extending moiety" refers to a molecule that prevents or mitigates in vivo degradation by proteolysis or other activity-diminishing chemical modification, increases in vivo half-life or other pharmacokinetic properties such as but not limited to increasing the rate of absorption, reduces toxicity, reduces immunogenicity, improves solubility, increases biological activity and/or target selectivity of the toxin peptide analog with respect to a target of interest, and/or increases manufacturability, compared to an unconjugated form of the toxin peptide analog. In accordance with the invention, the half-life extending moiety is one that is pharmaceutically acceptable.

The half-life extending moiety can be selected such that the inventive composition achieves a sufficient hydrodynamic size to prevent clearance by renal filtration in vivo. For example, a half-life extending moiety can be selected that is a polymeric macromolecule, which is substantially straight chain, branched-chain (br), or dendritic in form. Alternatively, a half-life extending moiety can be selected such that, in vivo, the inventive composition of matter will bind to a serum protein to form a complex, such that the complex thus formed avoids substantial renal clearance. The half-life extending moiety can be, for example, a lipid; a cholesterol group (such as a steroid); a carbohydrate or oligosaccharide; or any natural or synthetic protein, polypeptide or peptide that binds to a salvage receptor.

Exemplary half-life extending moieties that can be used, in accordance with the present invention, include an immunoglobulin Fc domain, or a portion thereof, or a biologically suitable polymer or copolymer, for example, a polyalkylene glycol compound, such as a polyethylene glycol (PEG) or a polypropylene glycol. Other appropriate polyalkylene glycol compounds include, but are not limited to, charged or neutral polymers of the following types: dextran, polylysine, colominic acids or other carbohydrate based polymers, polymers of amino acids, and biotin derivatives. In some monomeric fusion or conjugate protein embodiments an immunoglobulin (including light and heavy chains) or a portion thereof, can be used as a half-life-extending moiety, preferably an immunoglobulin of human origin, and including any of the immunoglobulins, such as, but not limited to, IgG1, IgG2, IgG3 or IgG4.

Other examples of the half-life extending moiety, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene maleic anhydride copolymer, a polyaminoacid (e.g., polylysine or polyornithine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, or a polysialic acid (e.g., PolyXen™ technology; Gregoriadis et al., Improving the therapeutic efficacy of peptides and proteins: a role for polysialic acids, Intl. J. Pharmaceutics, 300:125-30 (2005), incorporated herein by reference in its entirety).

In other embodiments of the composition of matter, the half-life extending moiety is an anionically charged chemical entity, covalently linked to the N-terminus of the toxin peptide analog, which anionically charged chemical entities include, but are not limited to, phosphotyrosine, phosphoserine, p-phosphono(difluoro-methyl)-phenylalanine (Pfp), p-phosphono-methyl-phenylalanine (Pmp), p-phosphatidylphenylalanine (Ppa), or p-phosphono-methylketo-phenylalanine (Pkp), which can be covalently linked to the N-terminal of the toxin peptide analog, optionally indirectly, via an AEEA linker or other linker as described herein. (See, Chandy et al., Analogs of ShK toxin and their uses in selective inhibition of Kv1.3 potassium channels, WO 2006/042151 A2; Beeton et al., Targeting effector memory T cells with a selective peptide inhibitor of Kv1.3 channels for therapy of autoimmune diseases, Molec. Pharmacol. 67(4): 1369-81 (2005); Pennington et al., Engineering a stable and selective peptide blocker of the Kv1.3 channel in T lymphocytes, Molecular Pharmacology Fast Forward, published Jan. 2, 2009 as doi:10.1124/mol.108.052704 (2009), all of which references are incorporated herein by reference in their entireties). AEEA is 2-(2-(2-aminoethoxy)ethoxy)acetic acid (also known as 8-Amino-3,6-Dioxaoctanoic Acid). (See, e.g., Beeton et al., Targeting effector memory T cells with a selective peptide inhibitor of Kv1.3 channels for therapy of autoimmune diseases, Molec. Pharmacol. 67(4): 1369-81 (2005)).

Other embodiments of the half-life extending moiety, in accordance with the invention, include peptide ligands or small (organic) molecule ligands that have binding affinity for a long half-life serum protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life serum protein, such as serum albumin. (See, e.g., Kratz, Albumin as a drug carrier: Design of prodrugs, drug conjugates and nanoparticles, Journal of Controlled Release 132:171-183 (2008); Dennis et al., Albumin binding as a general strategy for improving the pharmacokinetics of proteins, J. Biol. Chem. 277(38): 35035-43 (2002); Knudsen et al., Potent derivative of glucagon-like Peptide-1 with pharmacokinetic properties suitable for once daily administration, J. Med. Chem. 43:1664-69 (2000); Kurtzhals et al., Albumin binding of insulins acylated with fatty acids: characterization of the ligand-protein interaction and correlation between binding affinity and timing of the insulin effect in vivo, Biochem. J. 312:725-31 (1995); Kenyon et al., 13C NMR Studies of the binding of medium-chain fatty acids to human serum albumin, J. Lipid Res. 35:458-67 (1994); Blaney et al., Method and compositions for increasing the serum half-life of pharmacologically active agents by binding to transthyretin-selective ligands, U.S. Pat. No. 5,714,142; Sato et al., Serum albumin binding moieties, US 2003/0069395 A1; Jones et al., Pharmaceutical active conjugates, U.S. Pat. No. 6,342,225). A "long half-life serum protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable half-life extending moiety, such as, but not limited to, those described herein, or the use of a combination of two or more different half-life extending moieties, such as PEG and immunoglobulin Fc domain or a portion thereof (see, e.g., Feige et al., Modified peptides as therapeutic agents, U.S. Pat. No. 6,660,843), such as a CH2 domain of Fc, albumin (e.g., human serum albumin (HSA); see, e.g., Ehrlich et al., Preparation and characterization of albumin conjugates of a truncated Peptide YYY analogue for half-life extension, Bioconjugate Chemistry 24(12):2015-24 (2013); Rosen et al., Albumin fusion proteins, U.S. Pat. No. 6,926,898 and US 2005/0054051; Bridon et al., Protection of endogenous therapeutic peptides from peptidase activity through conjugation to blood components, U.S. Pat. No. 6,887,470), a transthyretin (TTR; see, e.g., Walker et al., Use of transthyretin peptide/protein fusions to increase the serum half-life of pharmacologically active peptides/proteins. US 2003/0195154 A1; 2003/0191056 A1), or a thyroxine-binding globulin (TBG), or a combination such as immunoglobulin(light chain+heavy chain) and Fc domain (the heterotrimeric combination a so-called "hemibody"), for example as described in Sullivan et al., Toxin Peptide Therapeutic Agents, PCT/US2007/022831, published as WO 2008/088422, which is incorporated herein by reference in its entirety.

Conjugation of the toxin peptide analogs(s) to the half-life extending moiety, or moieties, can be via the N-terminal and/or C-terminal of the toxin peptide, or can be intercalary as to its primary amino acid sequence, F1 being linked closer to the toxin peptide analog's N-terminus.

Figure 94A:
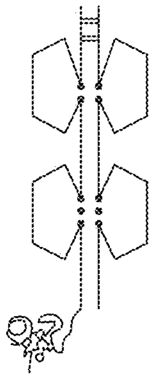
FIG. 94A-N shows schematic structures of some embodiments of a composition of the invention that include one or more units of a pharmacologically active toxin, e.g., toxin (e.g., JzTx-V) peptide analog (squiggle) fused, via an optional peptidyl linker moiety such as but not limited to L5 or L10 described herein, with one or more domains of an immunoglobulin. These schematics show a more typical IgG1, although they are intended to apply as well to IgG2s, which will have 4 disulfide bonds in the hinge and a different arrangement of the disulfide bond linking the heavy and light chain, and IgG3s and IgG4s.
Figure 94B:
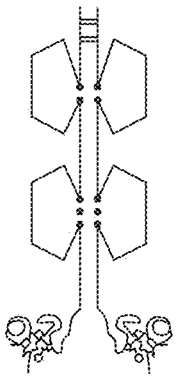
FIG. 94B represents a bivalent homodimeric Fc-toxin peptide analog fusion or conjugate, with toxin peptide analogs fused to the C-terminal ends of both of the immunoglobulin Fc domain monomers.
Figure 94C:
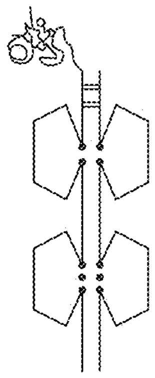
FIG. 94C represents a monovalent heterodimeric toxin peptide analog-Fc fusion or conjugate with the toxin peptide analog fused or chemically conjugated to the N-terminal end of one of the immunoglobulin Fc domain monomers.
Figure 94D:
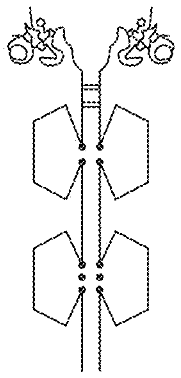
FIG. 94D represents a bivalent homodimeric toxin peptide analog-Fc fusion or conjugate, with toxin peptide analogs fused to the N-terminal ends of both of the immunoglobulin Fc domain monomers.
Figure 94E:
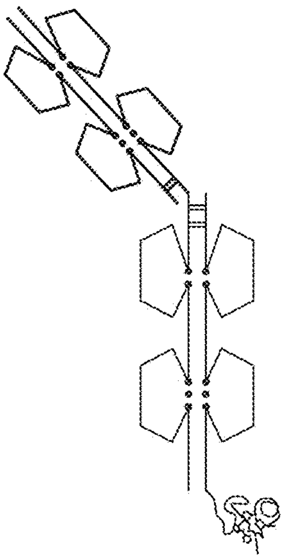
FIG. 94E represents a monovalent heterotrimeric Fc-toxin peptide analog/Ab comprising an immunoglobulin heavy chain (HC)+immunoglobulin light chain (LC)+an immunoglobulin Fc monomer with a toxin peptide analog fused to its C-terminal end.
Figure 94F:
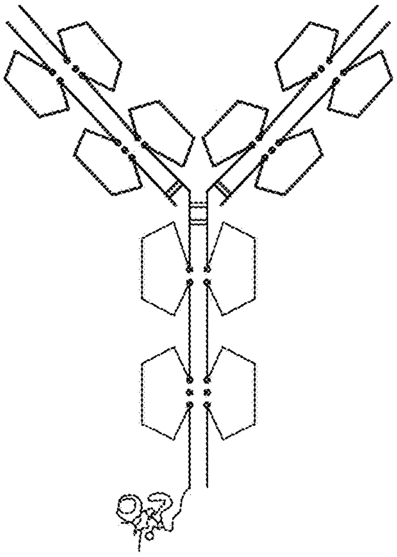
FIG. 94F represents a monovalent heterotetrameric (HT) antibody HC-toxin peptide analog fusion or conjugate, with a toxin peptide analog fused to the C-terminal end of one of the HC monomers.
Figure 94G:
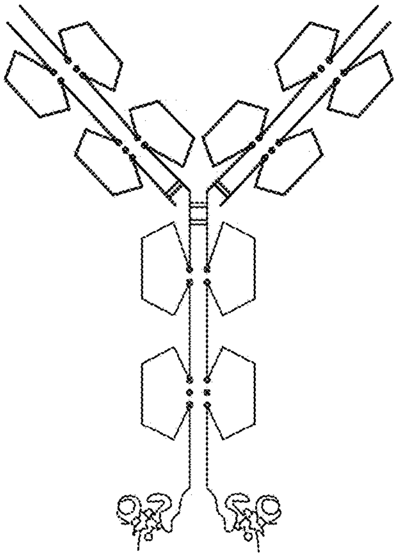
FIG. 94G represents a bivalent HT antibody Ab HC-toxin peptide analog fusion or conjugate having toxin peptide analogs on the C-terminal ends of both HC monomers.
Figure 94H:
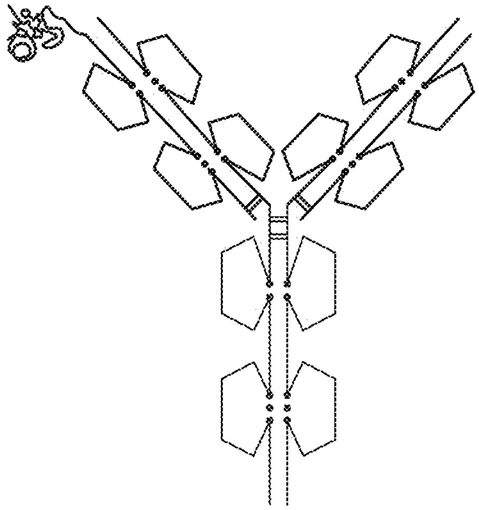
FIG. 94H represents a monovalent HT toxin peptide analog-LC Ab, with the toxin peptide analog fused to the N-terminal end of one of the LC monomers.
Figure 94I:
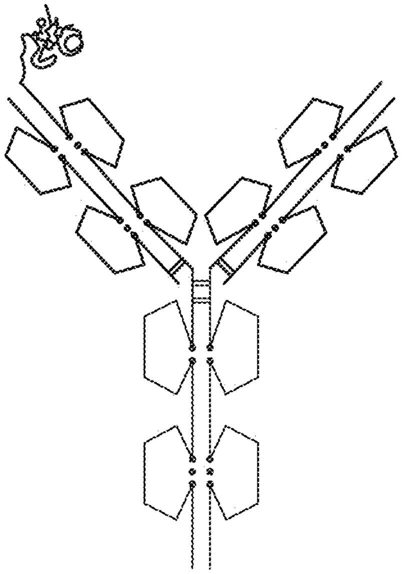
FIG. 94I represents a monovalent HT toxin peptide analog-HC Ab, with the toxin peptide analog fused to the N-terminal end of one of the HC monomers.
Figure 94J:
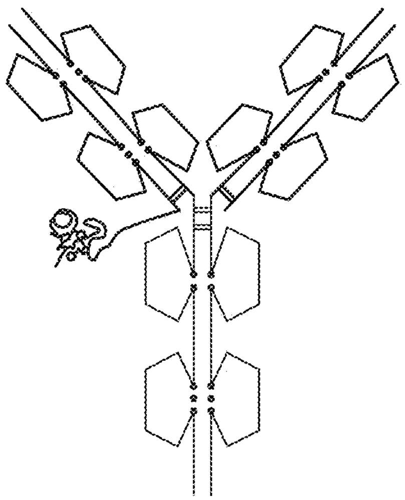
FIG. 94J represents a monovalent HT Ab LC-toxin peptide analog fusion or conjugate (i.e., LC-toxin peptide analog fusion or conjugate+LC+2(HC)), with the toxin peptide analog fused to the C-terminal end of one of the LC monomers.
Figure 94K:
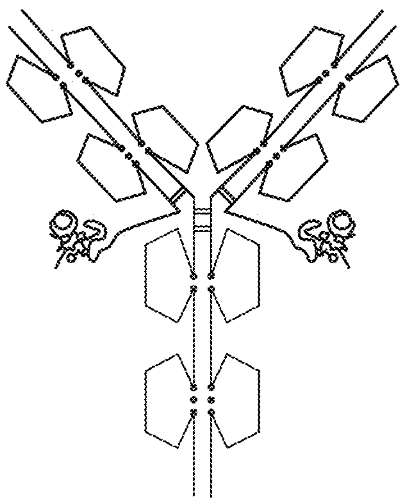
FIG. 94K represents a bivalent HT Ab LC-toxin peptide analog fusion or conjugate (i.e., 2(LC-toxin peptide analog fusion or conjugate)+2(HC)), with toxin peptide analogs fused to the C-terminal end of both of the LC monomers.
Figure 94L:
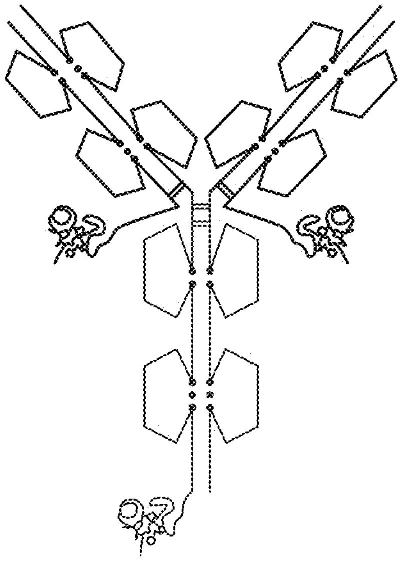
FIG. 94L represents a trivalent HT Ab LC-toxin peptide analog/HC-toxin peptide analog (i.e., 2(LC-toxin peptide analog fusion or conjugate)+HC-toxin peptide analog fusion or conjugate+HC), with the toxin peptide analogs fused to the C-terminal ends of both of the LC monomers and one of the HC monomers.
Figure 94M:
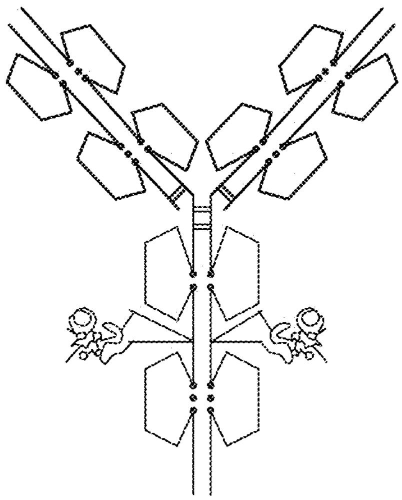
FIG. 94M represents a bivalent antibody with a toxin peptide analog moiety inserted into an internal loop of the immunoglobulin Fc domain of each HC monomer.
Figure 94N:
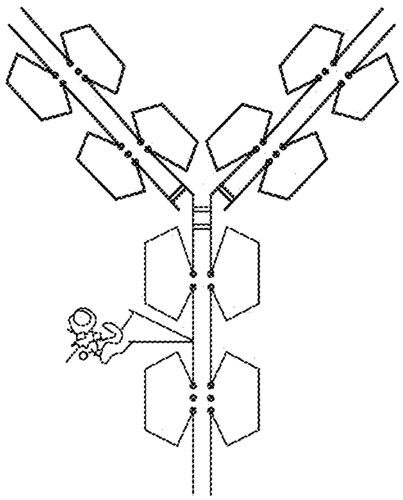
Figure 95:
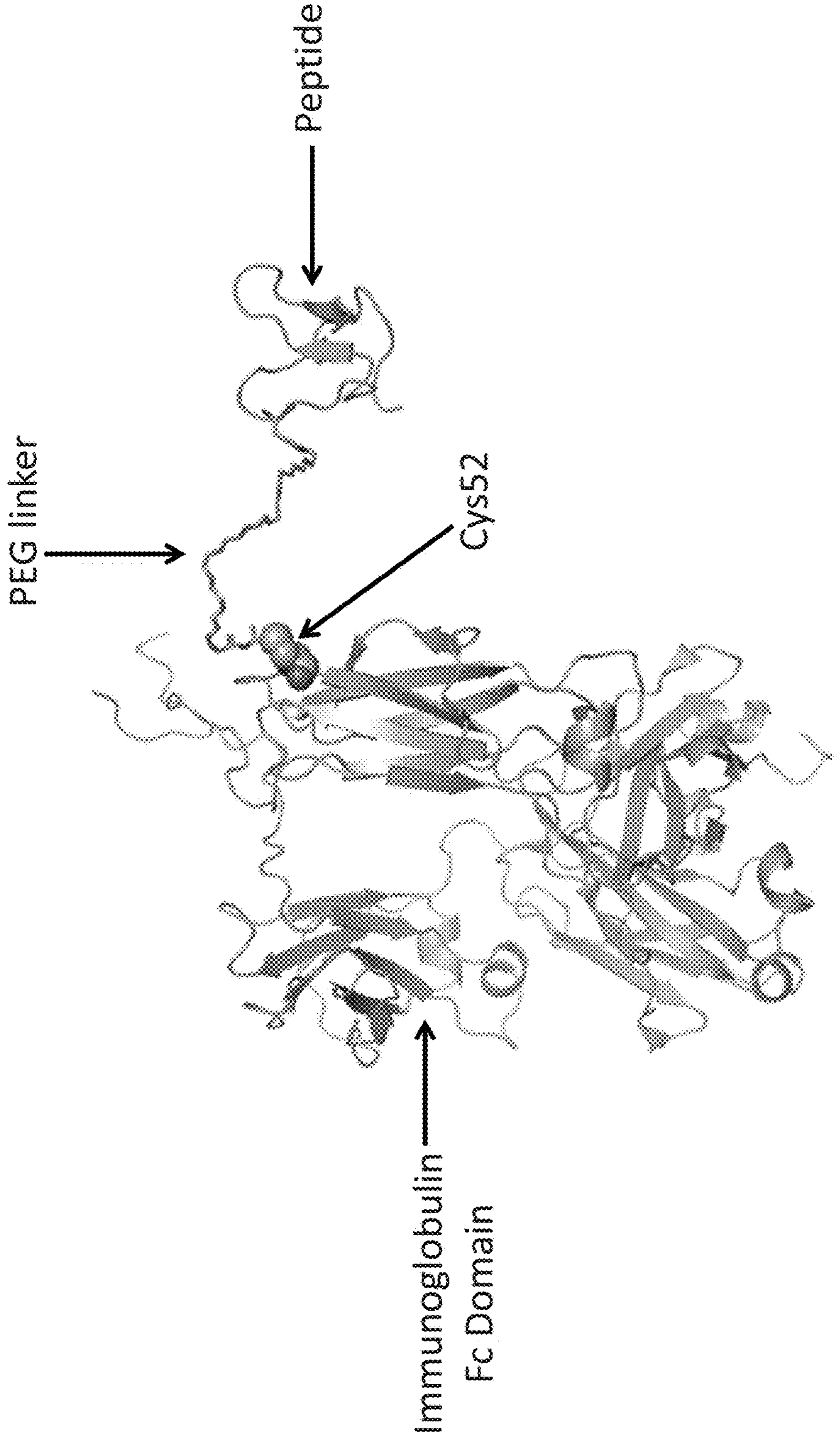
FIG. 95 shows a schematic representation of a Fc-peptide conjugate embodiment for illustrative purposes only. A homology model of the immunoglobulin anti-DNP mAb (E52C) hIgG1 Fc domain (homodimer of SEQ ID NO:544) is constructed from an immunoglobulin crystal structure (1HZH.pdb) and is depicted as a solid ribbon. Cys52 of SEQ ID NO:544, the site of conjugation, is rendered in CPK format. PEG11 linker is depicted as a solid tube, in an arbitrary conformation in this embodiment, connecting the C52 residue in the immunoglobulin Fc domain to an Atz residue in the peptide. Any other linkers described herein can be substituted for the PEG11 linker, for example see FIG. 91. Homology models of the JzTx-V peptide analog are displayed as a solid ribbon and shown in arbitrary relative orientations to the immunoglobulin in this embodiment. One peptide is shown to reflect the monvalent nature of this immunoglobulin-peptide conjugate, however bivalent, trivalent, or other multivalent embodiments can be made.
Figure 96:
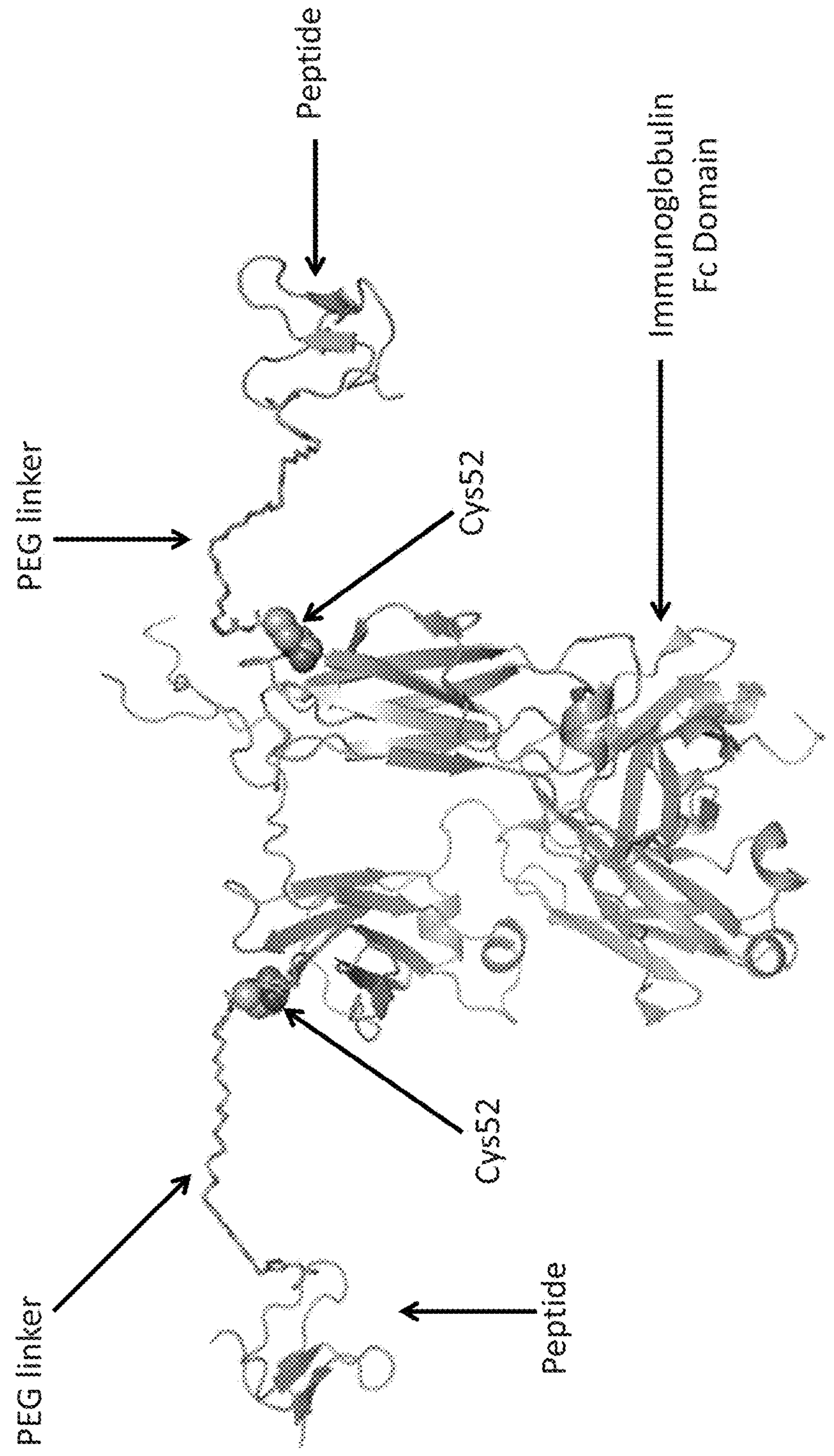
FIG. 96 shows a schematic representation of a Fc-peptide conjugate embodiment for illustrative purposes only. A homology model of the anti-DNP mAb (E52C) hIgG1 Fc domain (homodimer of SEQ ID NO:544) is constructed from an immunoglobulin crystal structure (1HZH.pdb) and is depicted as a solid ribbon. Cys52 residues of both Fc domain monomers (SEQ ID NO:544), are used as the sites of conjugation, and are rendered in CPK format. PEG11 linkers are depicted as solid tubes in this embodiment in an arbitrary conformation connecting the C52 residues in the immunoglobulin Fc domain to an Atz residue in the peptides. Any other linkers described herein can be substituted for the PEG11 linker, for example see FIG. 91. Homology models of the JzTx-V peptide analog are displayed as a solid ribbon and shown in arbitrary relative orientations to the immunoglobulin in this embodiment. Two peptides are shown to reflect the bivalent nature of immunoglobulin-peptide conjugate. Multivalent linkers as described herein allow for the display of more than two peptides.
Figure 97:
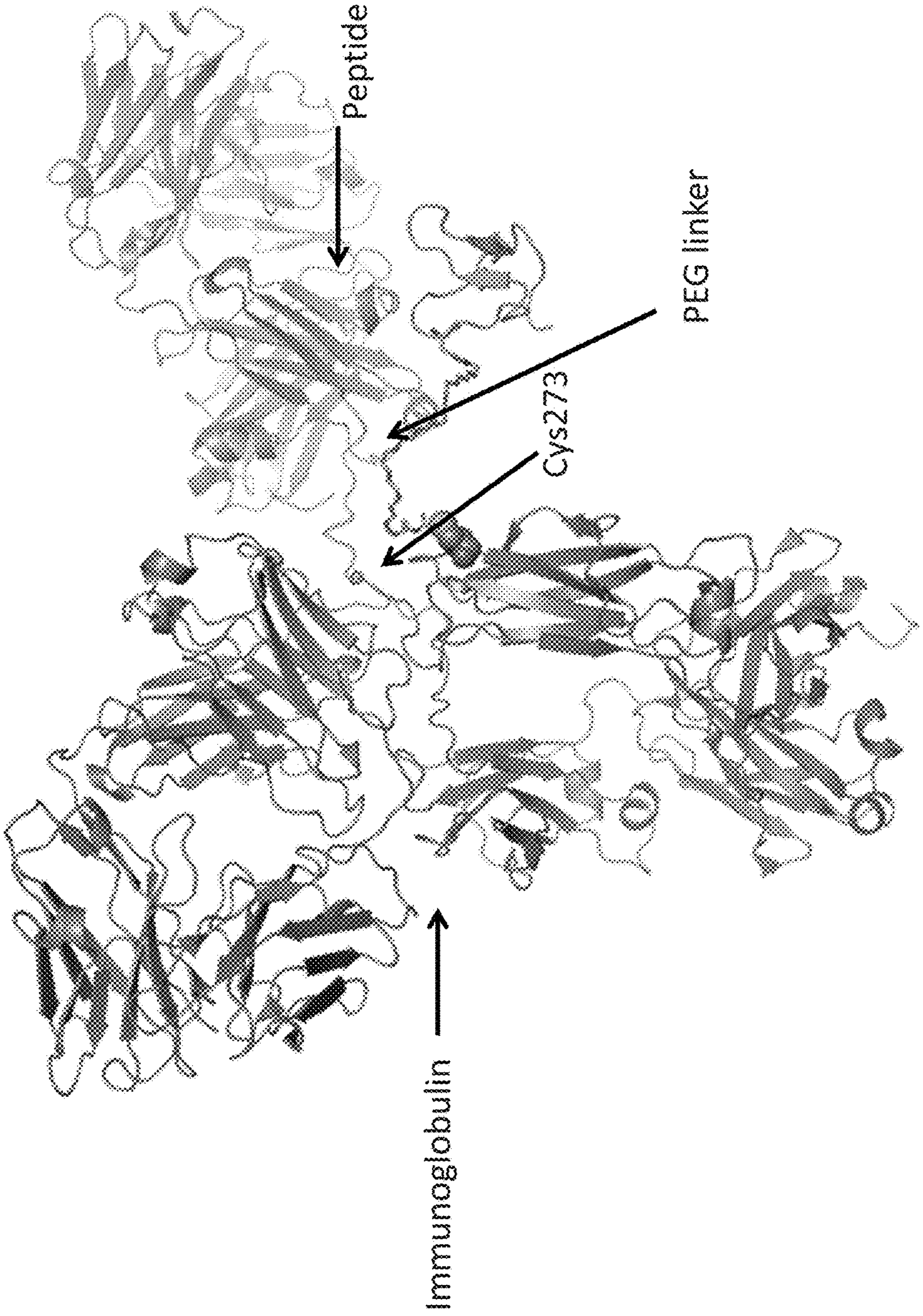
FIG. 97 shows a schematic representation of an immunoglobulin-peptide conjugate embodiment for illustrative purposes only. A homology model of the anti-DNP mAb (E273C) hIgG1 (comprising immunoglobulin monomers SEQ ID NO:542; SEQ ID NO:543; SEQ ID NO:542; SEQ ID NO:543) is constructed from an immunoglobulin crystal structure (1HZH.pdb) and is depicted as a solid ribbon. Cys273, the site of conjugation, is rendered in CPK format. In this embodiment, a PEG11 linker is depicted as a solid tube in an arbitrary conformation connecting the C273 residue in the immunoglobulin to an Atz residue in the peptide. Any other linkers described herein can be substituted for the PEG11 linker, for example see FIG. 91. Homology models of the JzTx-V peptide analog are displayed as a solid ribbon and shown in arbitrary relative orientations to the immunoglobulin in this embodiment. One peptide is shown to reflect the monvalent nature of this immunoglobulin-peptide conjugate, however bivalent, trivalent, or other multivalent embodiments can be made.
Figure 98:
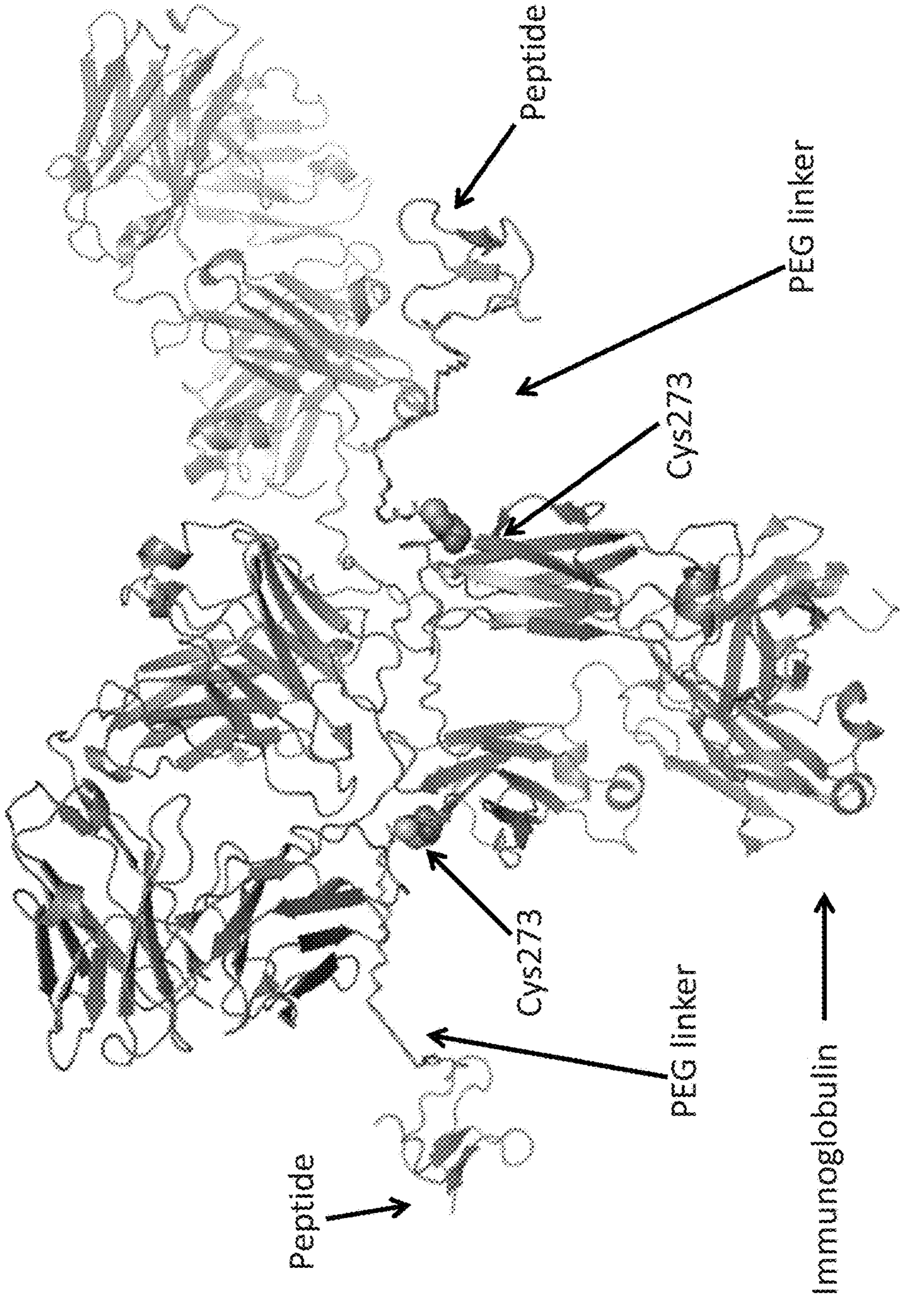
FIG. 98 shows a schematic representation of an immunoglobulin-peptide conjugate embodiment for illustrative purposes only. A homology model of the anti-DNP mAb (E273C) hIgG1 (comprising immunoglobulin monomers SEQ ID NO:542; SEQ ID NO:543; SEQ ID NO:542; SEQ ID NO:543) is constructed from an immunoglobulin crystal structure (1HZH.pdb) and is depicted as a solid ribbon. Both Cys273 residues, the sites of conjugation, are rendered in CPK format. In this embodiment, PEG11 linkers are depicted as solid tubes in an arbitrary conformation connecting the C273 residues in the immunoglobulin to an Atz residue in each of the peptides. Any other linkers described herein can be substituted for the PEG11 linker, for example see FIG. 91. Homology models of the JzTx-V peptide analog are displayed as a solid ribbon and shown in arbitrary relative orientations to the immunoglobulin in this embodiment. Two peptides are shown to reflect the bivalent nature of immunoglobulin-peptide conjugate. Multivalent linkers as described herein allow for the display of more than two peptides.
Figure 99:
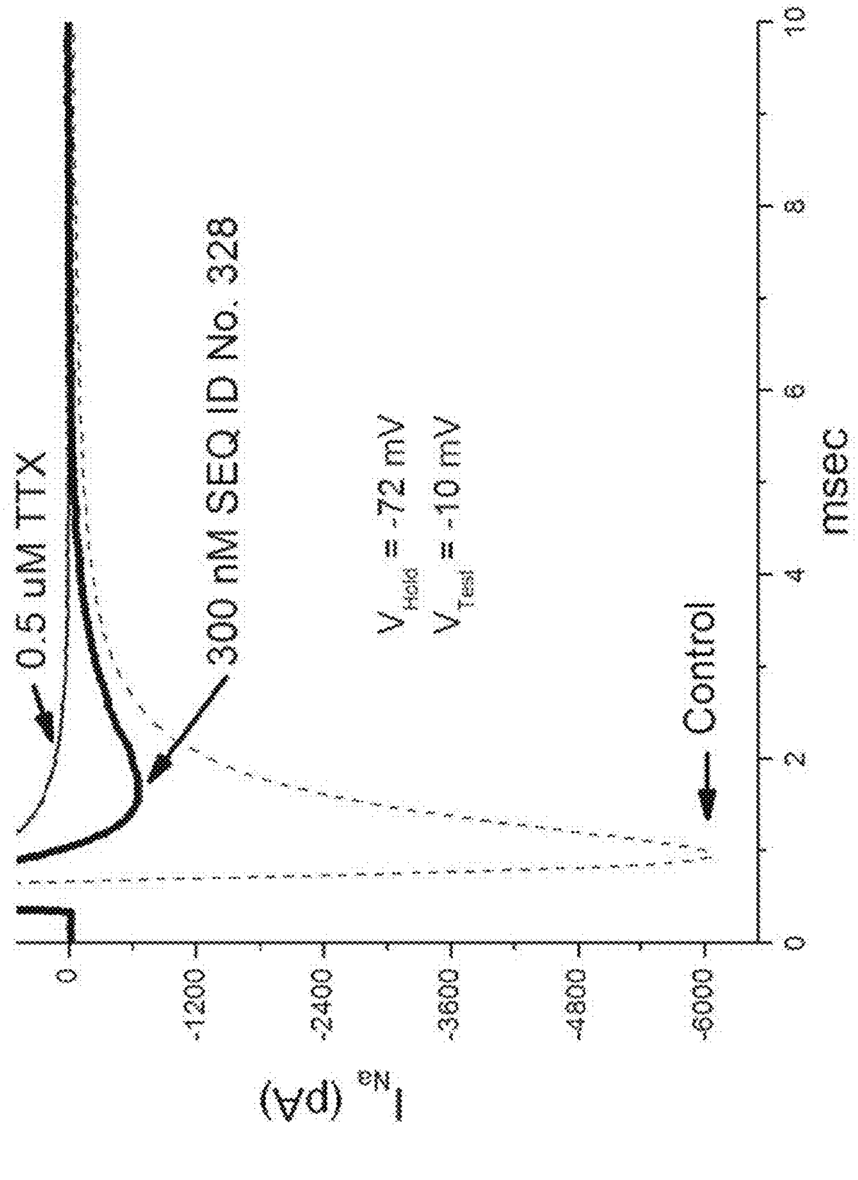
FIG. 99 shows the effect of a JzTx-V peptide analog Pra-[Nle6; Glu28]JzTx-V(1-29) (SEQ ID No. 328) on TTX-sensitive Nav channels in C57 Black 6 mouse DRG neuron. Cell was held at −72 mV and peak inward Nav currents were measured at −10 mV. 'Control' trace shows Nav current before Seq ID No. 328, '300 nM Seq ID No. 328' trace shows Nav current after Seq ID No. 328 addition, and '0.5 μM TTX' trace shows Nav current after TTX. Note that 300 nM Seq ID No. 328 blocks approximately 90% of TTX-sensitive Nav current and 0.5 μM TTX completely blocks TTX-sensitive Nav current.
Figure 100:
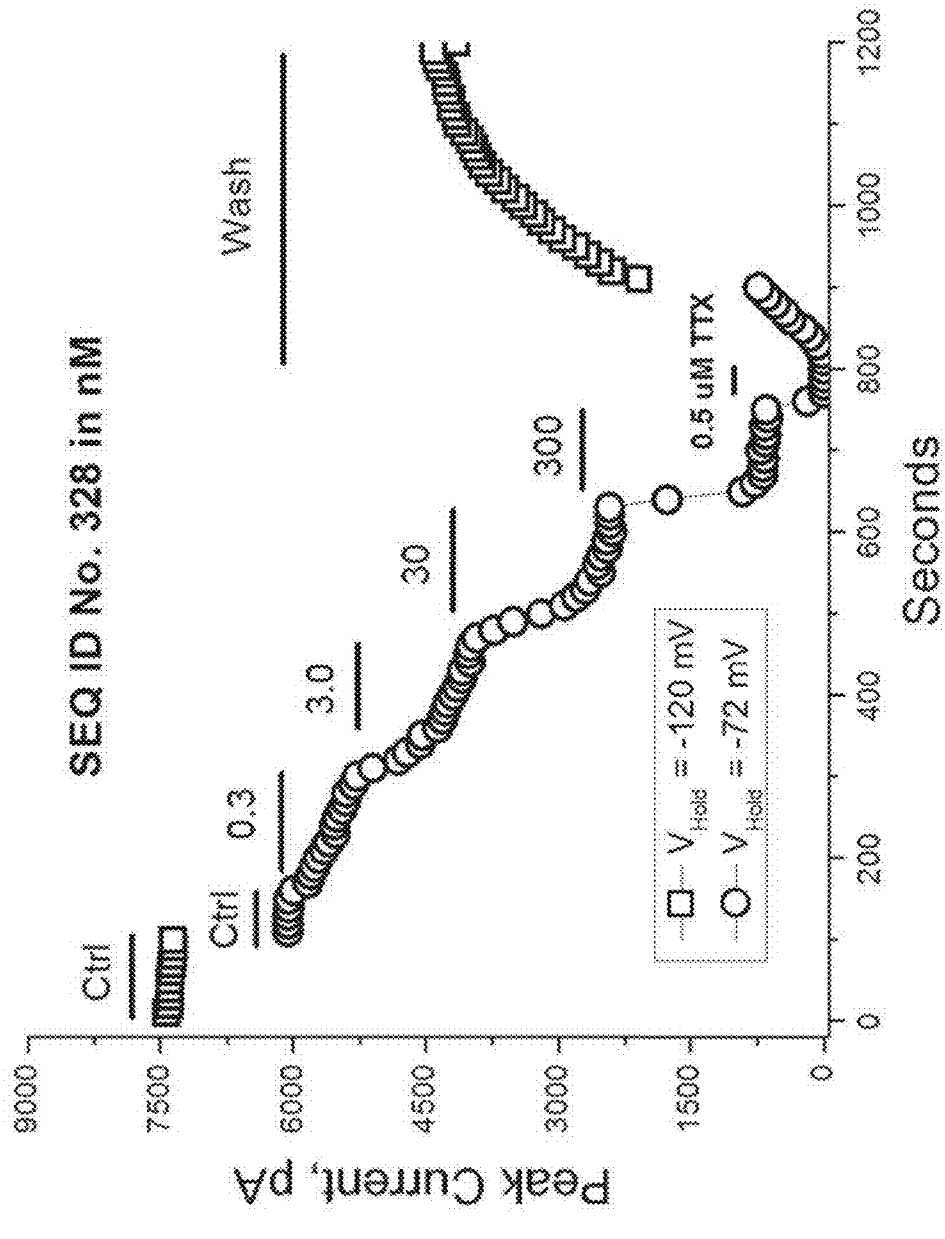
FIG. 100 shows the time course of increasing concentrations of Pra-[Nle6; Glu28]JzTx-V(1-29) (Seq ID No. 328) against TTX-sensitive Nav channels in C57 Black 6 mouse DRG neuron. Peak inward Nav currents were measured at −10 mV every 10 seconds in the presence of increasing concentrations of Seq ID No. 328; cell was held at either −120 mV (squares), a voltage where Nav channels are completely non-inactivated, or −72 mV (circles), a voltage that yields approximately 20% inactivation. 'Ctrl' indicates Nav current in the absence of Seq ID No. 328, '0.5 μM TTX' indicates Nav current in the presence of 0.5 μM TTX, and 'Wash' indicates Nav current following removal of Seq ID No. 328 and TTX.
Figure 101:
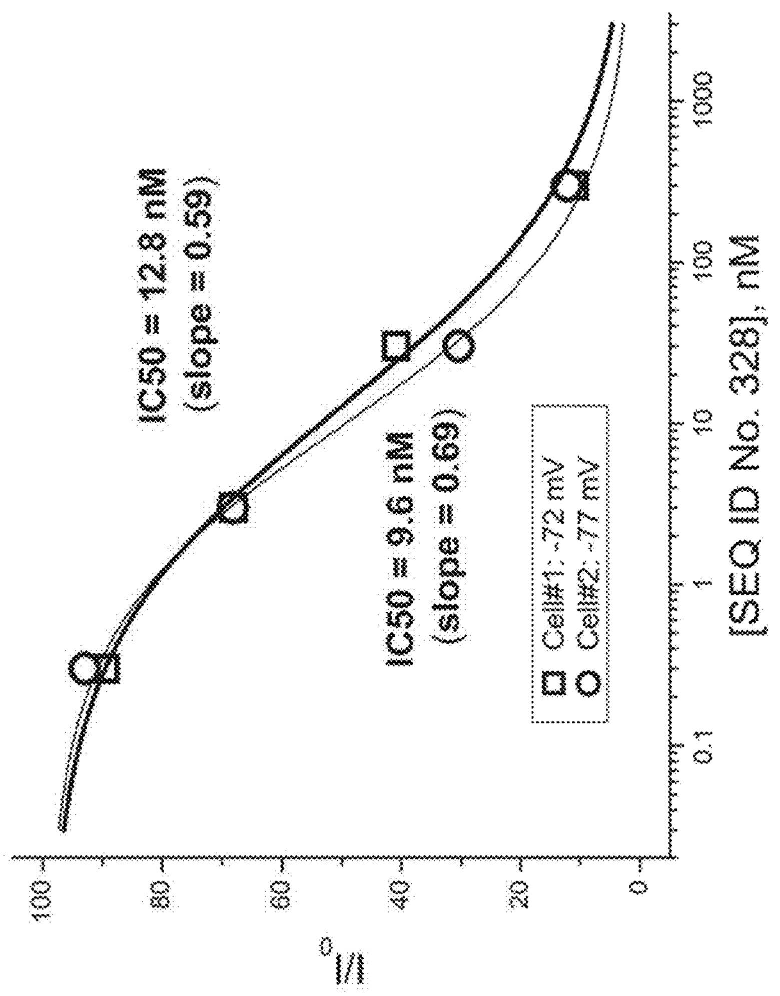
FIG. 101 shows the dose-response curves of Pra-[Nle6; Glu28]JzTx-V(1-29) (Seq ID No. 328) against TTX-sensitive Nav channels in two separate C57 Black 6 mouse DRG neurons. Peak inward Nav currents were measured at −10 mV in the presence of increasing concentrations of Seq ID No. 328 and divided by current before Seq ID No. 328 addition ($I/I_0$); cells were held at a voltage that yielded approximately 20% inactivation.
Figure 102:
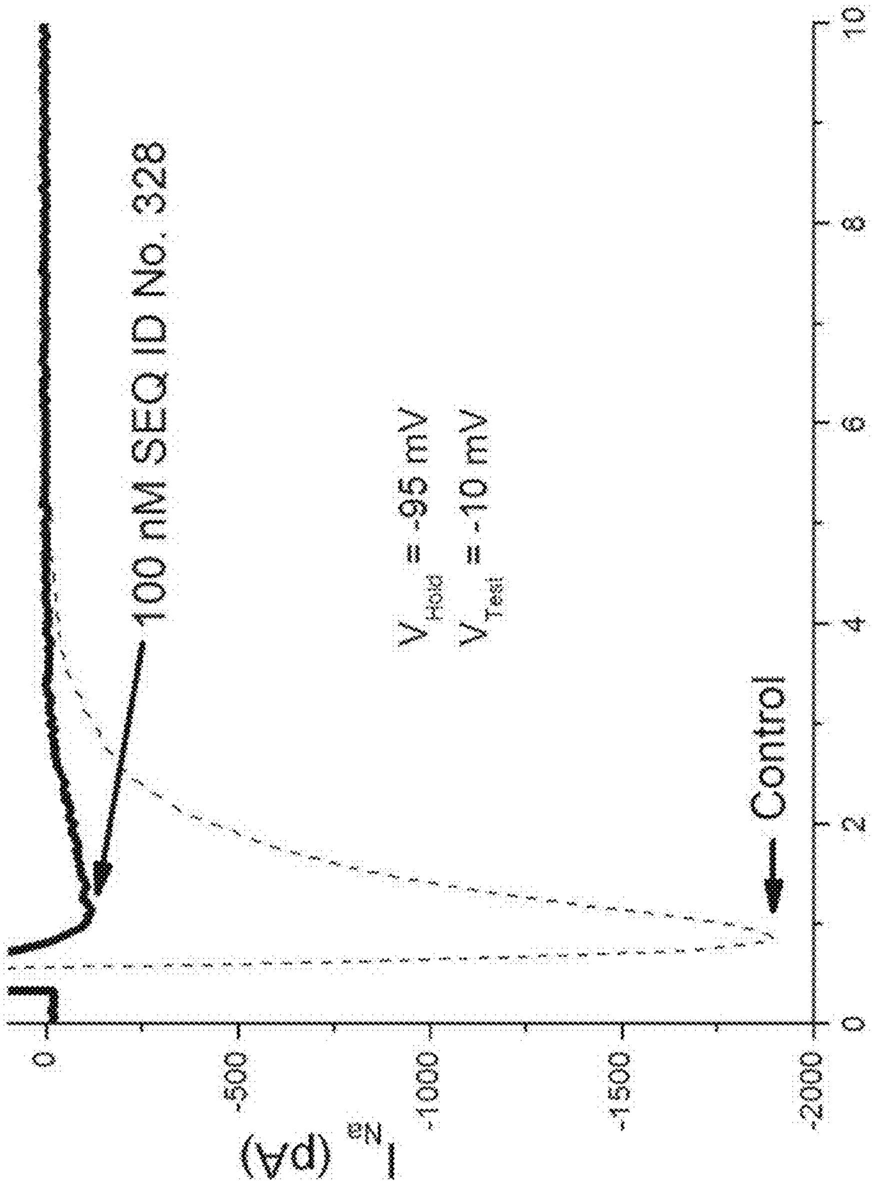
FIG. 102 shows the effect of Pra-[Nle6; Glu28]JzTx-V (1-29)(Seq ID No. 328) on human Nav1.7 Na channels expressed in HEK293 cells. Cell was held at −95 mV and peak inward Nav currents were measured at −10 mV. 'Control' trace shows Nav current before Seq ID No. 328, and '100 nM Seq ID No. 328' trace shows Nav current after Seq ID No. 328 addition. Note that 100 nM Seq ID No. 328 blocks approximately 95% of Nav current.
Figure 103:
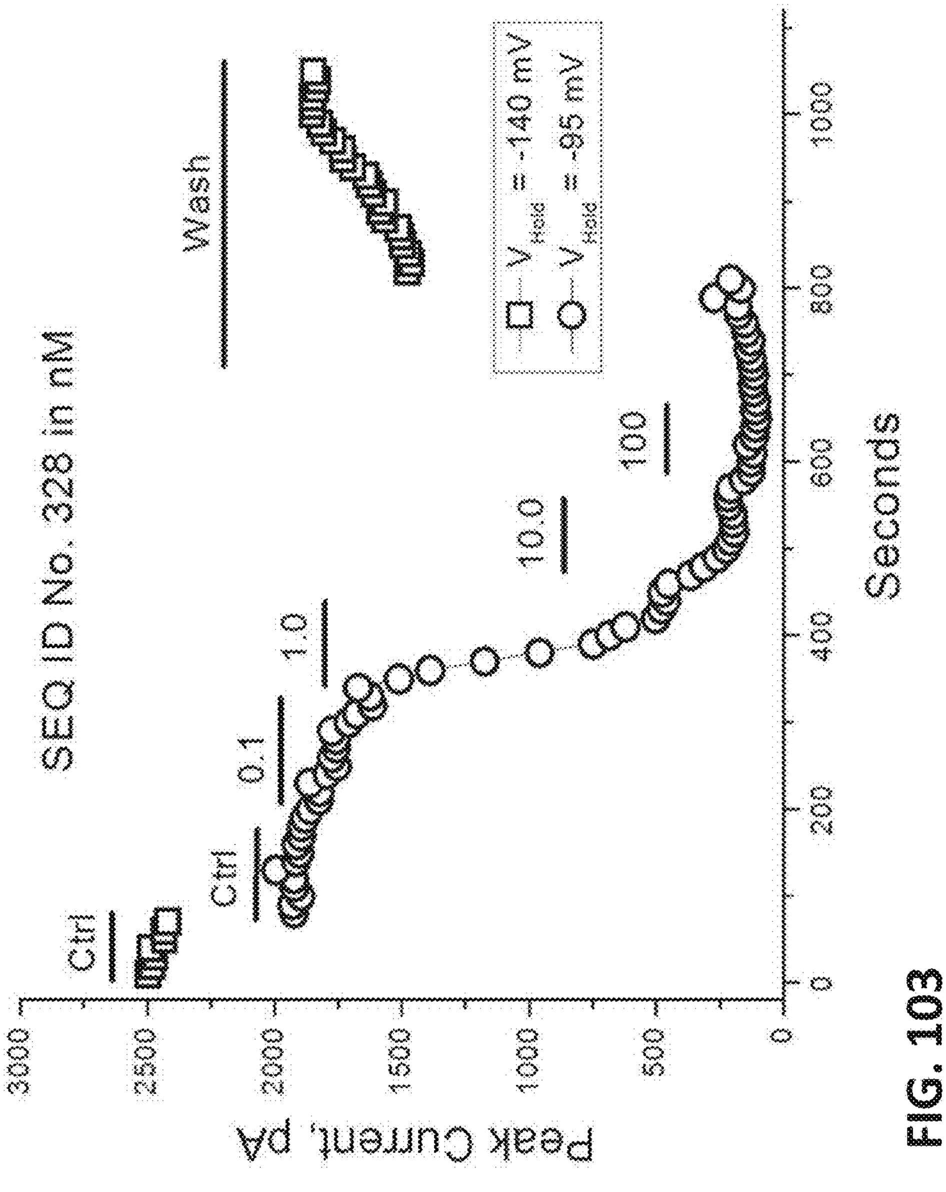
FIG. 103 shows the time course of increasing concentrations of Pra-[Nle6; Glu28]JzTx-V(1-29) (Seq ID No. 328) against human Nav1.7 Na channels expressed in HEK293 cells. Peak inward Nav currents were measured at −10 mV every 10 seconds in the presence of increasing concentrations of Seq ID No. 328; cell was held at either −140 mV (squares), a voltage where Nav channels are completely non-inactivated, or −95 mV (circles), a voltage that yields approximately 20% inactivation. 'Ctrl' indicates Nav current in the absence of Seq ID No. 328 and 'Wash' indicates Nav current following removal of Seq ID No. 328.
Figure 104:
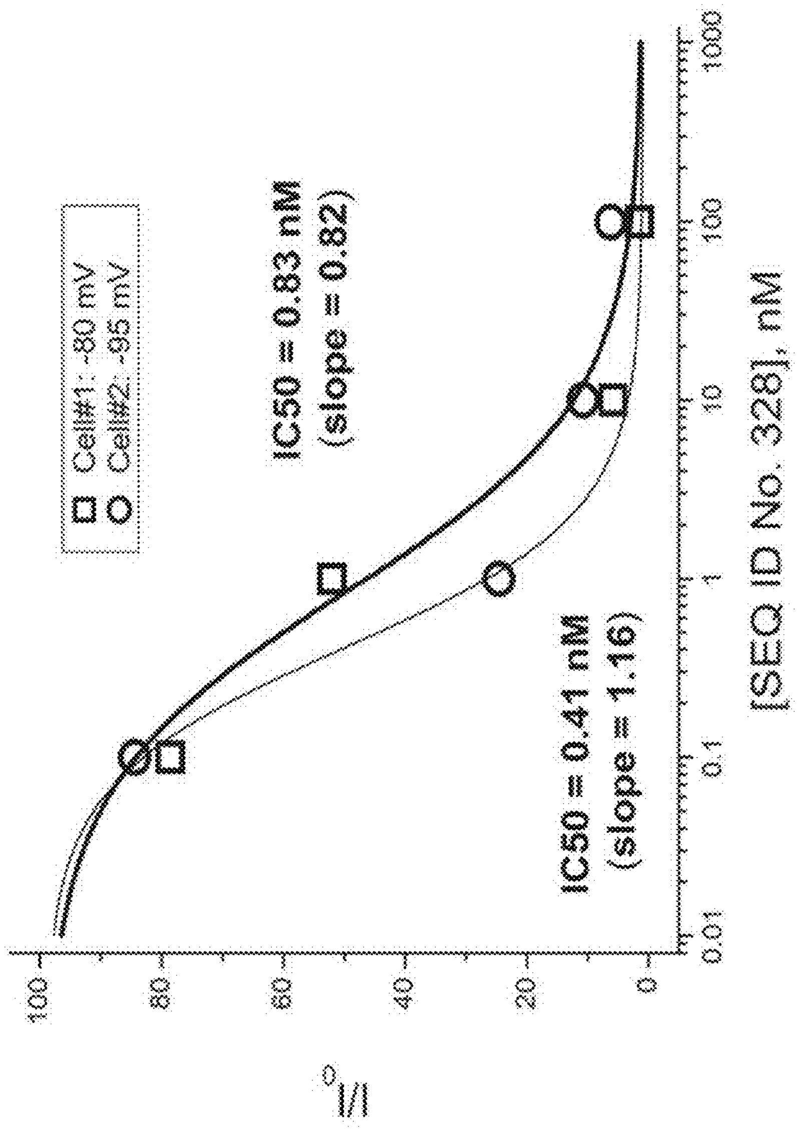
FIG. 104 shows the dose-response curves of Pra-[Nle6; Glu28]JzTx-V(1-29) (Seq ID No. 328) against human Nav1.7 Na channels in two separate HEK293 cells. Peak inward Nav currents were measured at −10 mV in the presence of increasing concentrations of Pra-[Nle6; Glu28] JzTx-V(1-29) (Seq ID No. 328) and divided by current before Seq ID No. 328 addition ($I/I_0$); cells were held at a voltage that yielded approximately 20% inactivation.
Figure 105:
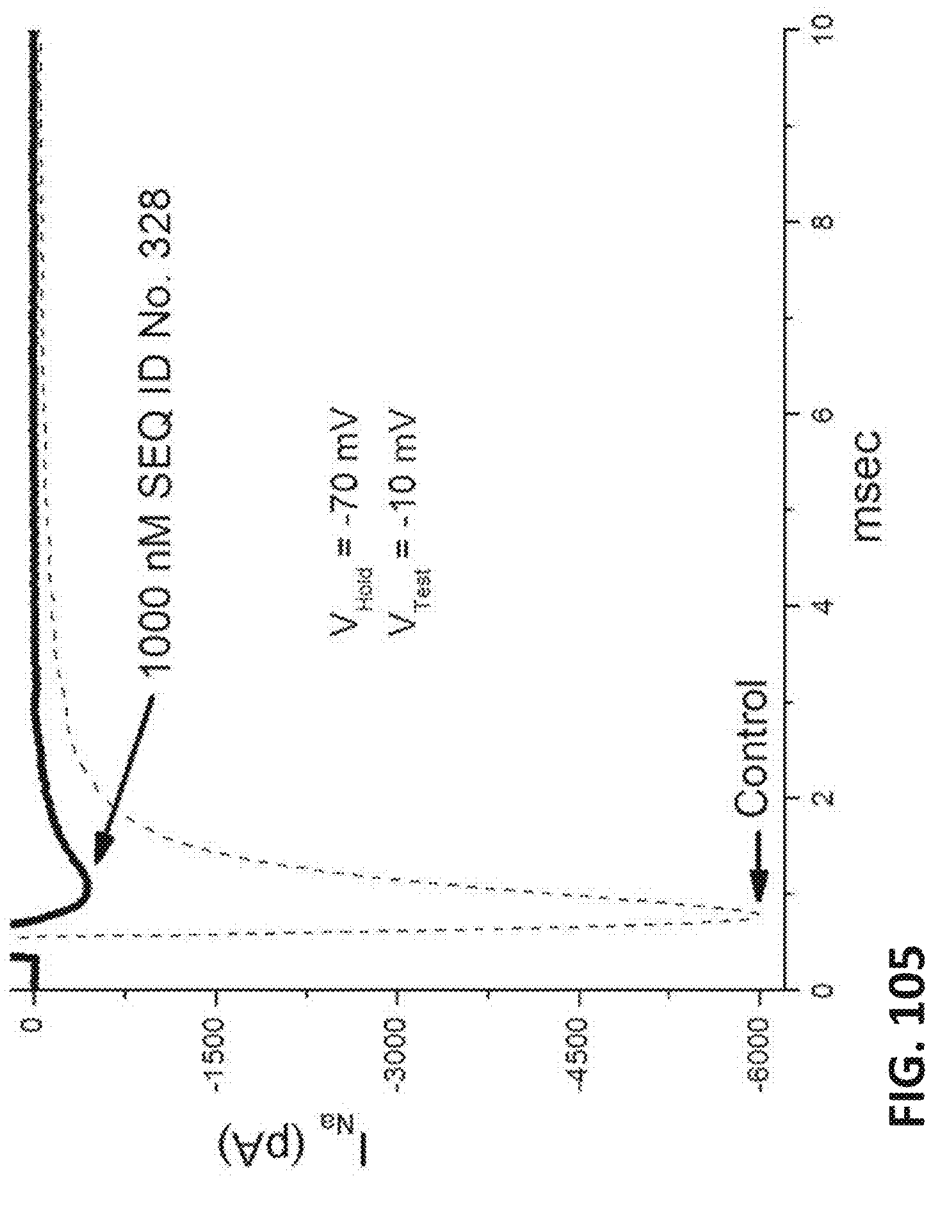
FIG. 105 shows the effect of Pra-[Nle6; Glu28]JzTx-V (1-29) (Seq ID No. 328) on human Nav1.1 Na channels expressed in HEK293 cells. Cell was held at −70 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM Pra-[Nle6; Glu28]JzTx-V(1-29) (Seq ID No. 328) blocks approximately 95% of Nav current.
Figure 106:
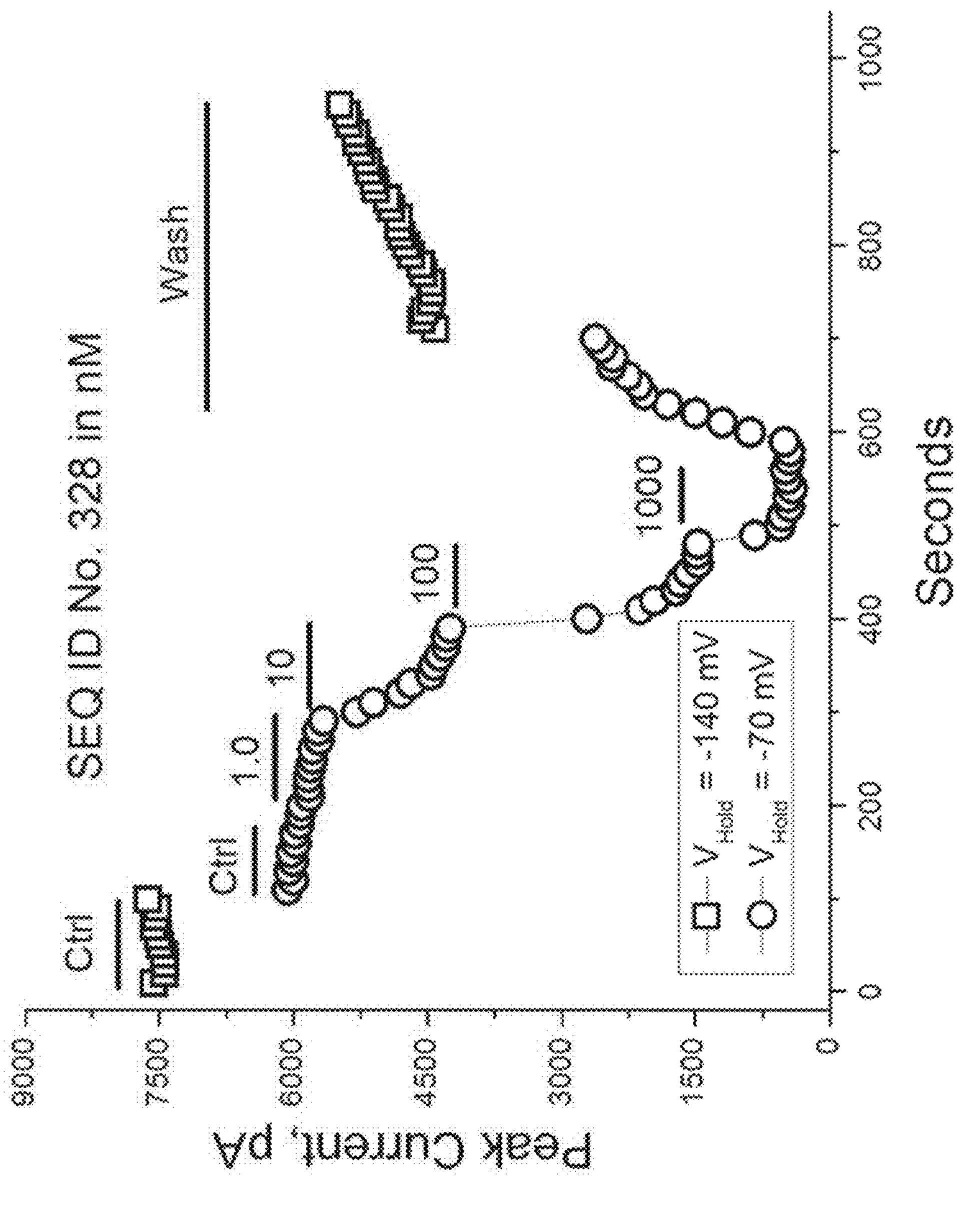
FIG. 106 shows the time course of increasing concentrations of Pra-[Nle6; Glu28]JzTx-V(1-29) (Seq ID No. 328) against human Nav1.1 Na channels expressed in HEK293 cells. Peak inward Nav currents were measured at −10 mV every 10 seconds in the presence of increasing concentrations of Seq ID No. 328; cell was held at either −140 mV (squares), a voltage where Nav channels are completely non-inactivated, or −70 mV (circles), a voltage that yields approximately 20% inactivation. 'Ctrl' indicates Nav current in the absence of Seq ID No. 328 and 'Wash' indicates Nav current following removal of Pra-[Nle6; Glu28]JzTx-V(1-29) (Seq ID No. 328).
Figure 107:
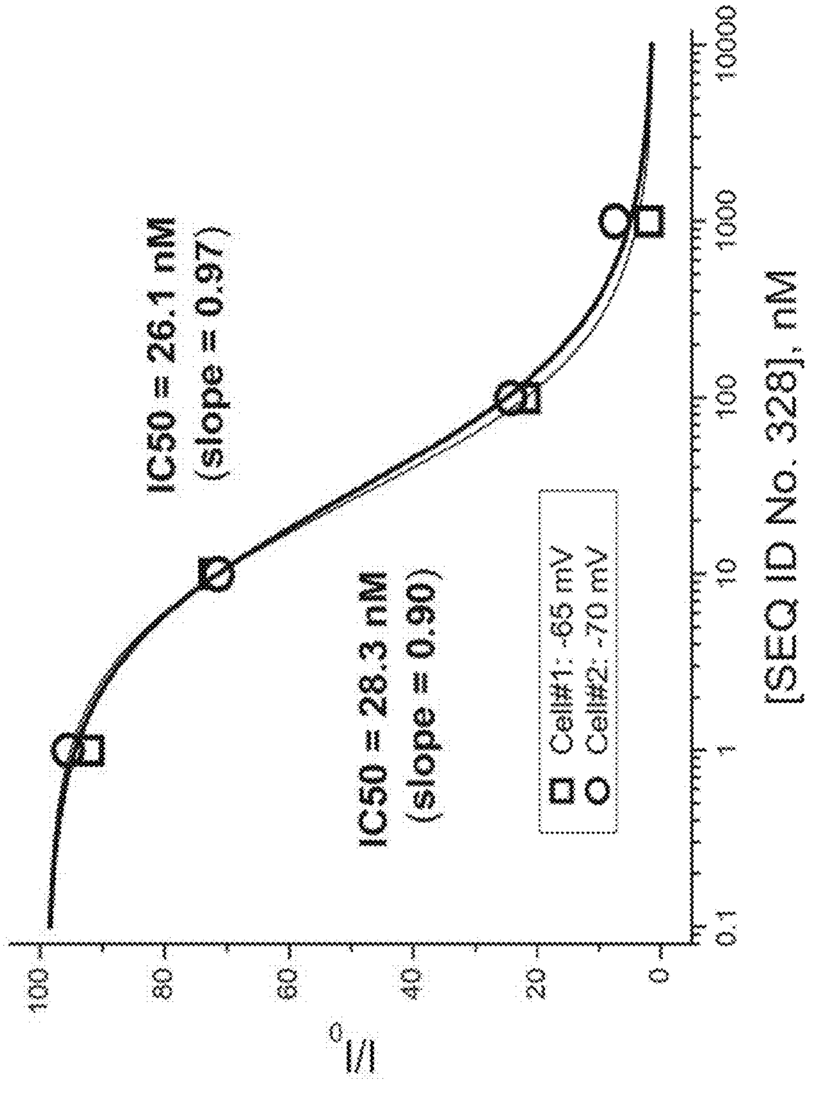
FIG. 107 shows the dose-response curves of Pra-[Nle6; Glu28]JzTx-V(1-29) (Seq ID No. 328) against human Nav1.1 Na channels in two separate HEK293 cells. Peak inward Nav currents were measured at −10 mV in the presence of increasing concentrations of Seq ID No. 328 and divided by current before Seq ID No. 328 addition ($I/I_0$); cells were held at a voltage that yielded approximately 20% inactivation.
Figure 108:
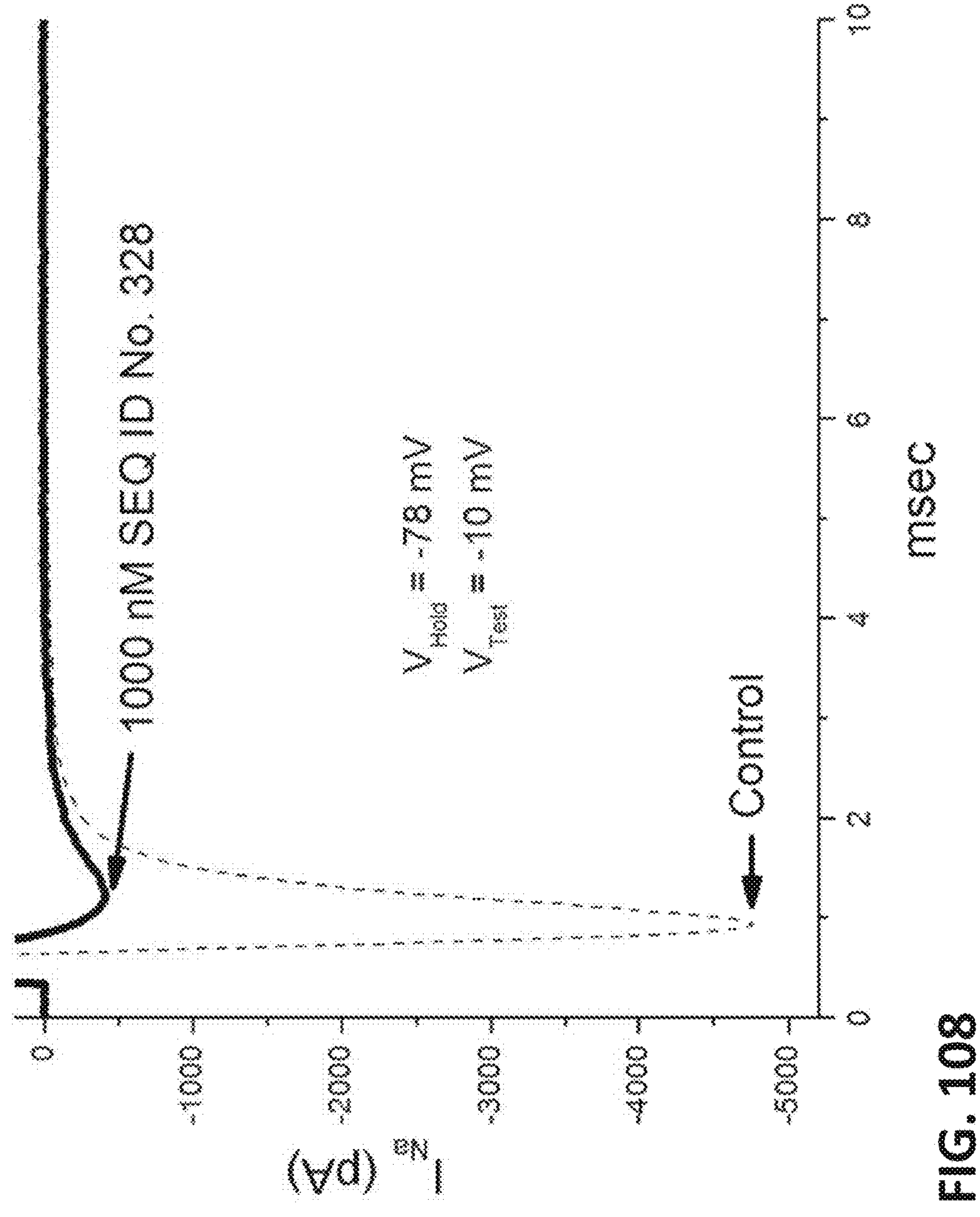
FIG. 108 shows the effect of Pra-[Nle6; Glu28]JzTx-V (1-29) (Seq ID No. 328) on human Nav1.4 Na channels expressed in HEK293 cells. Cell was held at −78 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM of Pra-[Nle6; Glu28]JzTx-V(1-29) (Seq ID No. 328) blocks approximately 90% of Nav current.
Figure 109:
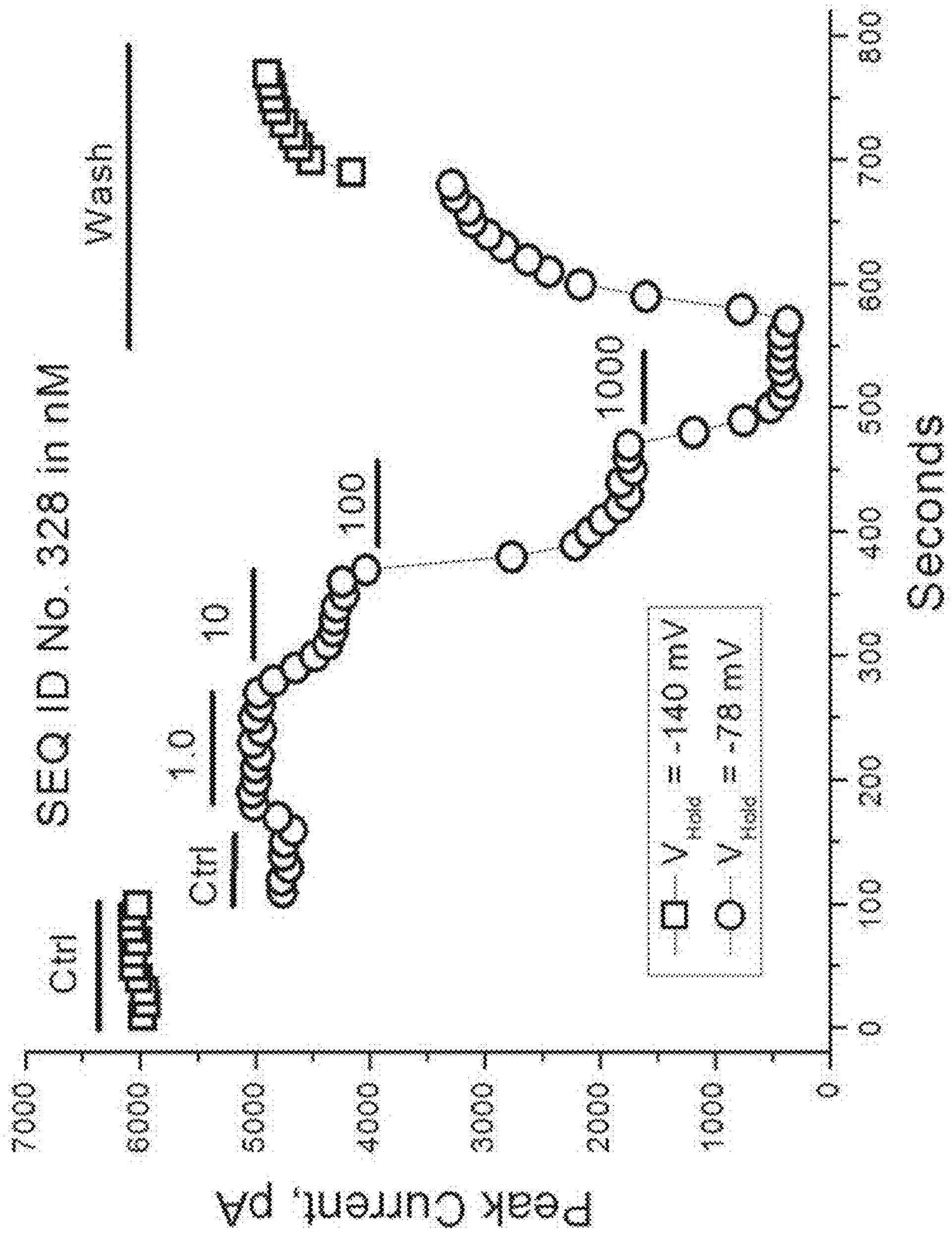
FIG. 109 shows the time course of increasing concentrations of Pra-[Nle6; Glu28]JzTx-V(1-29) (Seq ID No. 328) against human Nav1.4 Na channels expressed in HEK293 cells. Peak inward Nav currents were measured at −10 mV every 10 seconds in the presence of increasing concentrations of Pra-[Nle6; Glu28]JzTx-V(1-29) (Seq ID No. 328); cell was held at either −140 mV (squares), a voltage where Nav channels are completely non-inactivated, or −78 mV (circles), a voltage that yields approximately 20% inactivation. 'Ctrl' indicates Nav current in the absence of Seq ID No. 328 and 'Wash' indicates Nav current following removal of Pra-[Nle6; Glu28]JzTx-V(1-29) (Seq ID No. 328).
Figure 110:
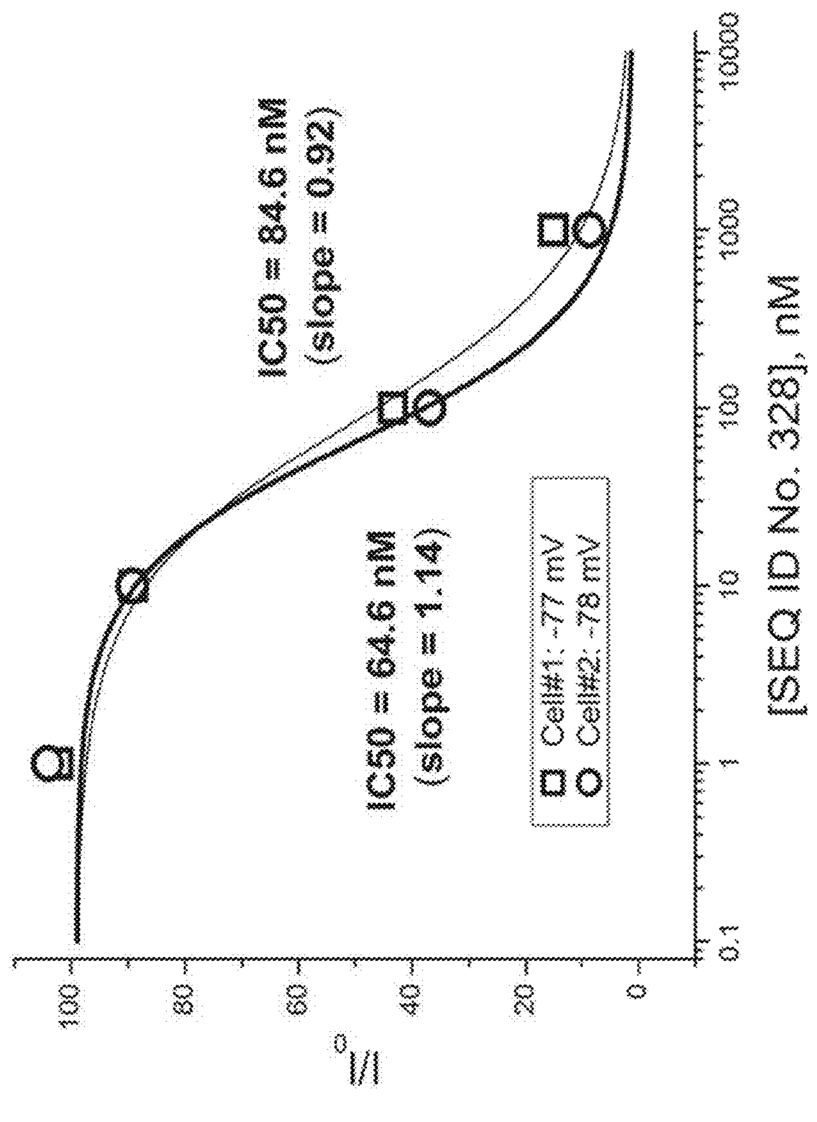
FIG. 110 shows the dose-response curves of Pra-[Nle6; Glu28]JzTx-V(1-29) (Seq ID No. 328) against human Nav1.4 Na channels in two separate HEK293 cells. Peak inward Nav currents were measured at −10 mV in the presence of increasing concentrations of Seq ID No. 328 and divided by current before Pra-[Nle6; Glu28]JzTx-V(1-29) (Seq ID No. 328) addition ($I/I_0$); cells were held at a voltage that yielded approximately 20% inactivation.
Figure 111:
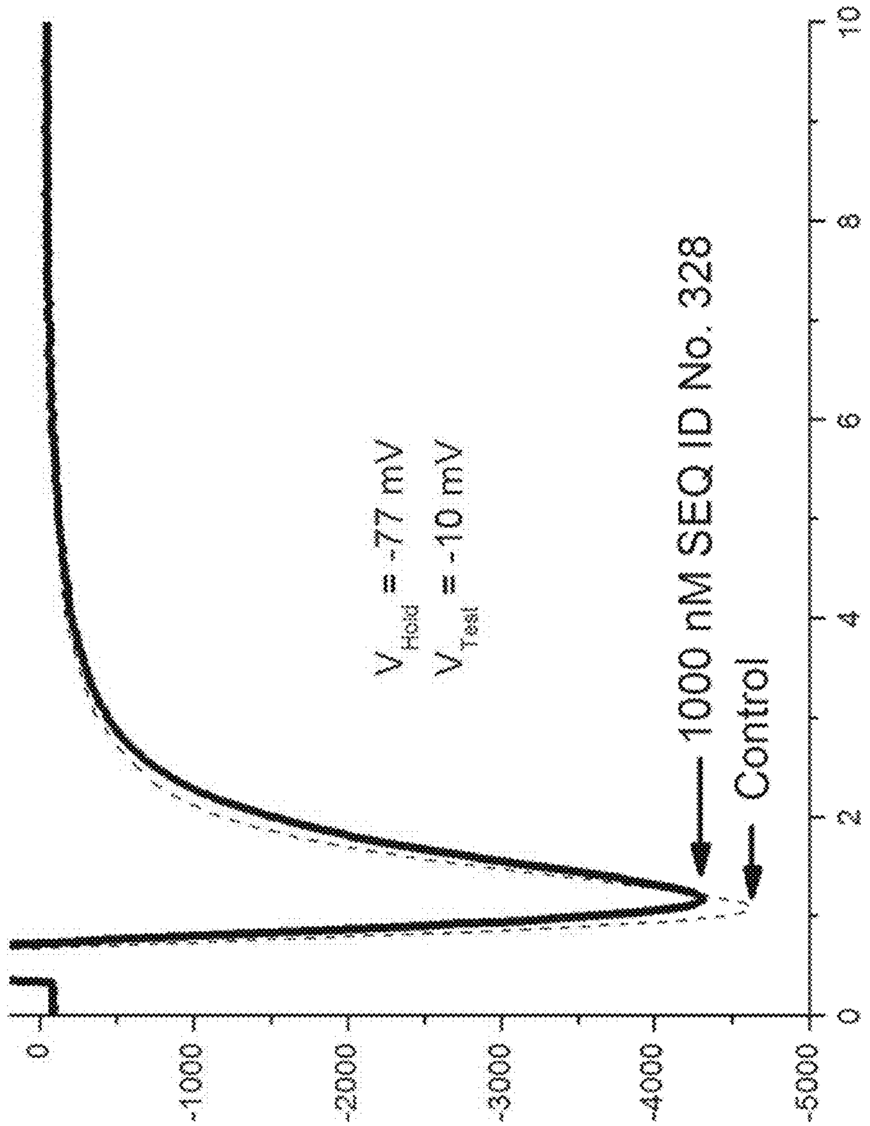
FIG. 111 shows the effect of Pra-[Nle6; Glu28]JzTx-V(1-29) (Seq ID No. 328) on human Nav1.5 Na channels expressed in HEK293 cells. Cell was held at −77 mV and peak inward Nav currents were measured at −10 mV. 'Control' trace shows Nav current before Seq ID No. 328, and '1000 nM Seq ID No. 328' trace shows Nav current after Pra-[Nle6; Glu28]JzTx-V(1-29) (Seq ID No. 328 addition). Note that 1000 nM Seq ID No. 328 blocks less than 10% of Nav current.
Figure 112:
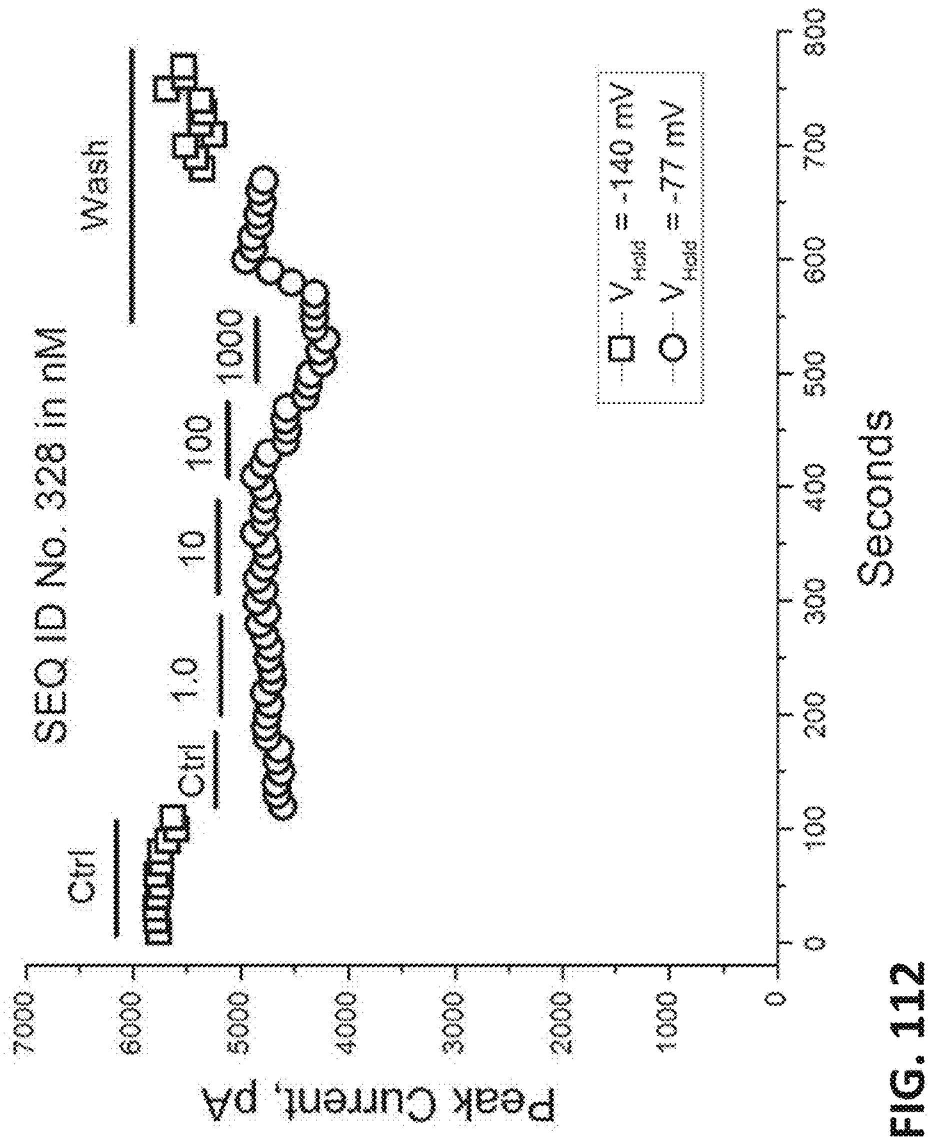
FIG. 112 shows the time course of increasing concentrations of Pra-[Nle6; Glu28]JzTx-V(1-29) (Seq ID No. 328) against human Nav1.5 Na channels expressed in HEK293 cells. Peak inward Nav currents were measured at −10 mV every 10 seconds in the presence of increasing concentrations of Pra-[Nle6; Glu28]JzTx-V(1-29) (Seq ID No. 328); cell was held at either −140 mV (squares), a voltage where Nav channels are completely non-inactivated, or −77 mV (circles), a voltage that yields approximately 20% inactivation. 'Ctrl' indicates Nav current in the absence of Seq ID No. 328 and 'Wash' indicates Nav current following removal of Pra-[Nle6; Glu28]JzTx-V(1-29) (Seq ID No. 328).
Figure 113:
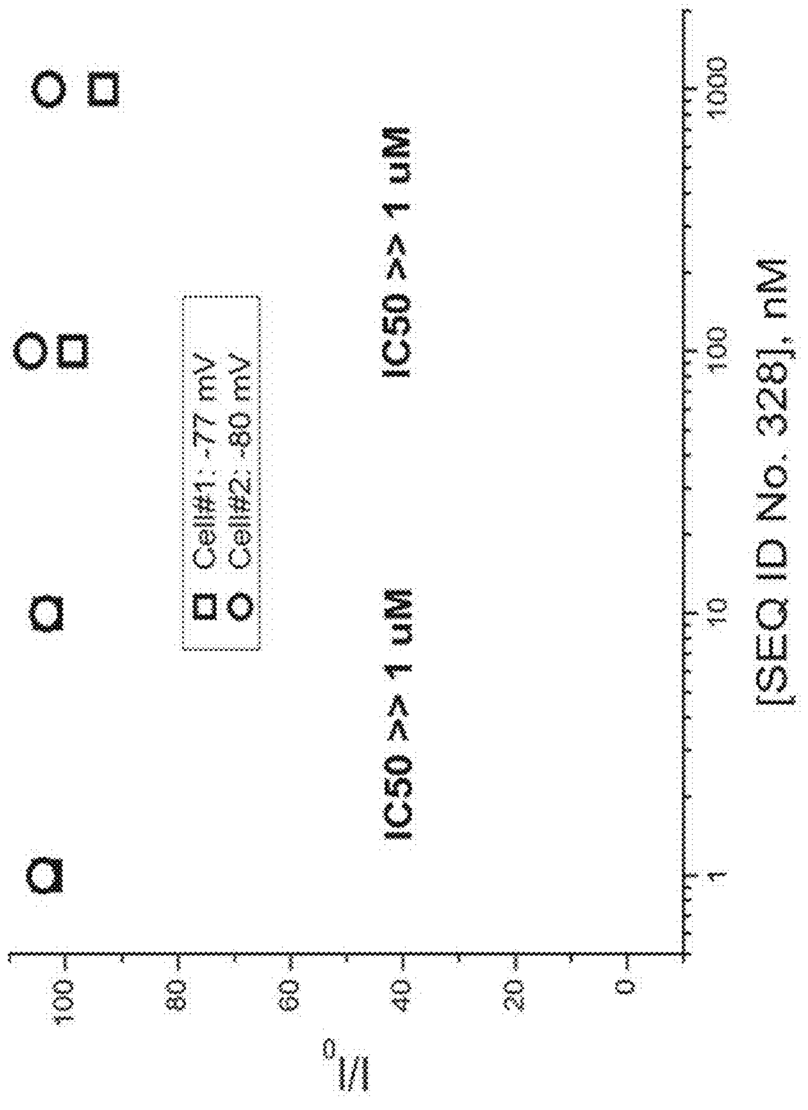
FIG. 113 shows the dose-response curves of Pra-[Nle6; Glu28]JzTx-V(1-29) (Seq ID No. 328) against human Nav1.5 Na channels in two separate HEK293 cells. Peak inward Nav currents were measured at −10 mV in the presence of increasing concentrations of Seq ID No. 328 and divided by current before Seq ID No. 328 addition ($I/I_0$); cells were held at a voltage that yielded approximately 20% inactivation.
Figure 114:
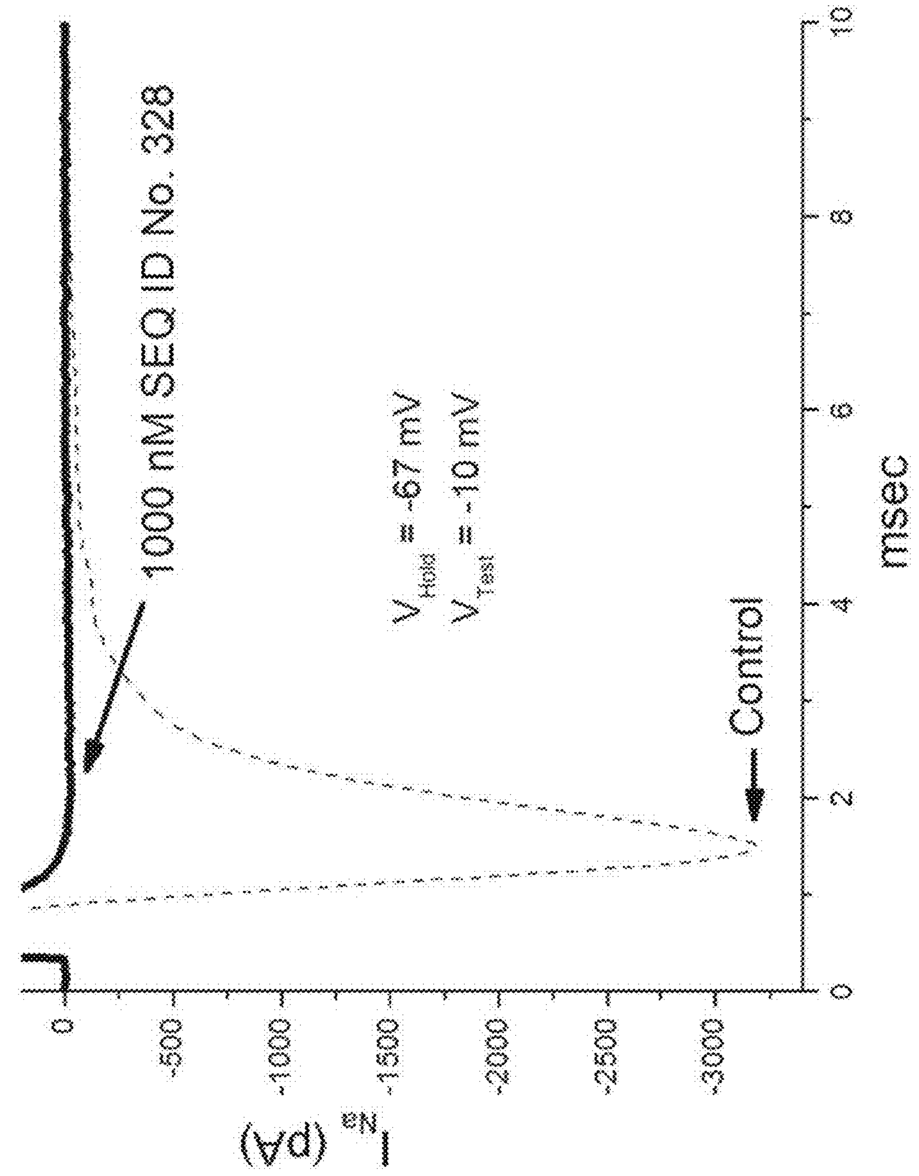
FIG. 114 shows the effect of Pra-[Nle6; Glu28]JzTx-V (1-29) (Seq ID No. 328) on human Nav1.6 Na channels expressed in HEK293 cells. Cell was held at −67 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM Pra-[Nle6; Glu28]JzTx-V(1-29) (Seq ID No. 328) blocks the majority of Nav current.
Figure 115:
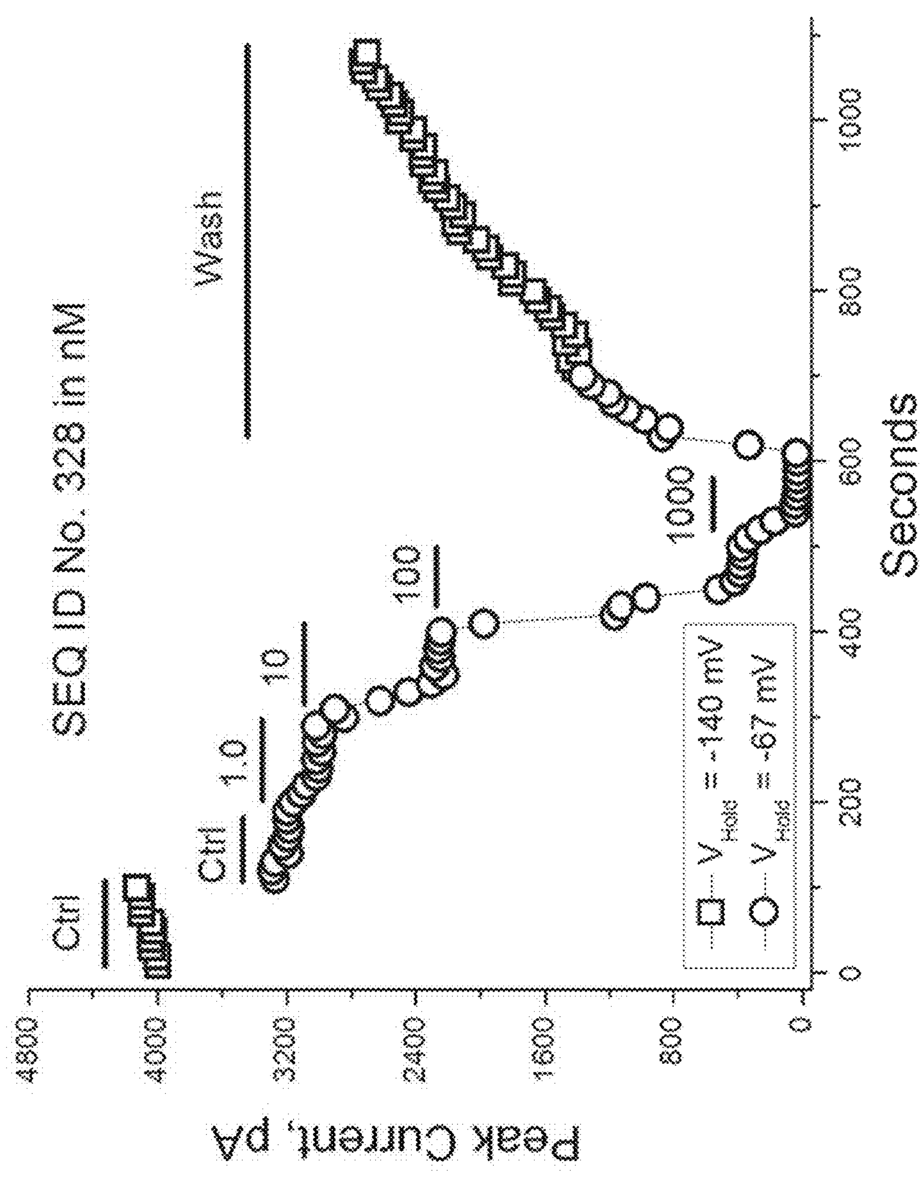
FIG. 115 shows the time course of increasing concentrations of Pra-[Nle6; Glu28]JzTx-V(1-29) (Seq ID No. 328) against human Nav1.6 Na channels expressed in HEK293 cells. Peak inward Nav currents were measured at −10 mV every 10 seconds in the presence of increasing concentrations of Seq ID No. 328; cell was held at either −140 mV (squares), a voltage where Nav channels are completely non-inactivated, or −67 mV (circles), a voltage that yields approximately 20% inactivation. 'Ctrl' indicates Nav current in the absence of Pra-[Nle6; Glu28]JzTx-V(1-29) (Seq ID No. 328) and 'Wash' indicates Nav current following removal of Pra-[Nle6; Glu28]JzTx-V(1-29) (Seq ID No. 328).
Figure 116:
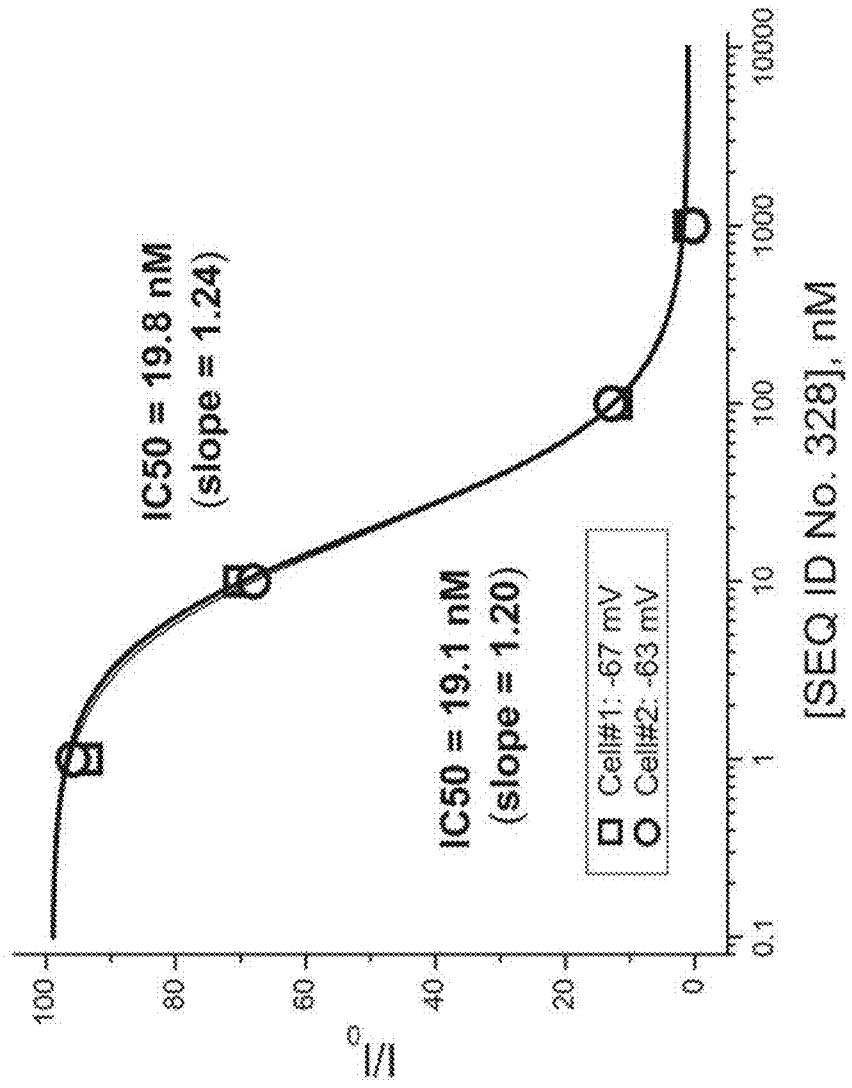
FIG. 116 shows the dose-response curves of Pra-[Nle6; Glu28]JzTx-V(1-29) (Seq ID No. 328) against human Nav1.6 Na channels in two separate HEK293 cells. Peak inward Nav currents were measured at −10 mV in the presence of increasing concentrations of Seq ID No. 328 and divided by current before Pra-[Nle6; Glu28]JzTx-V(1-29) (Seq ID No. 328) addition ($I/I_0$); cells were held at a voltage that yielded approximately 20% inactivation.
Figure 117:
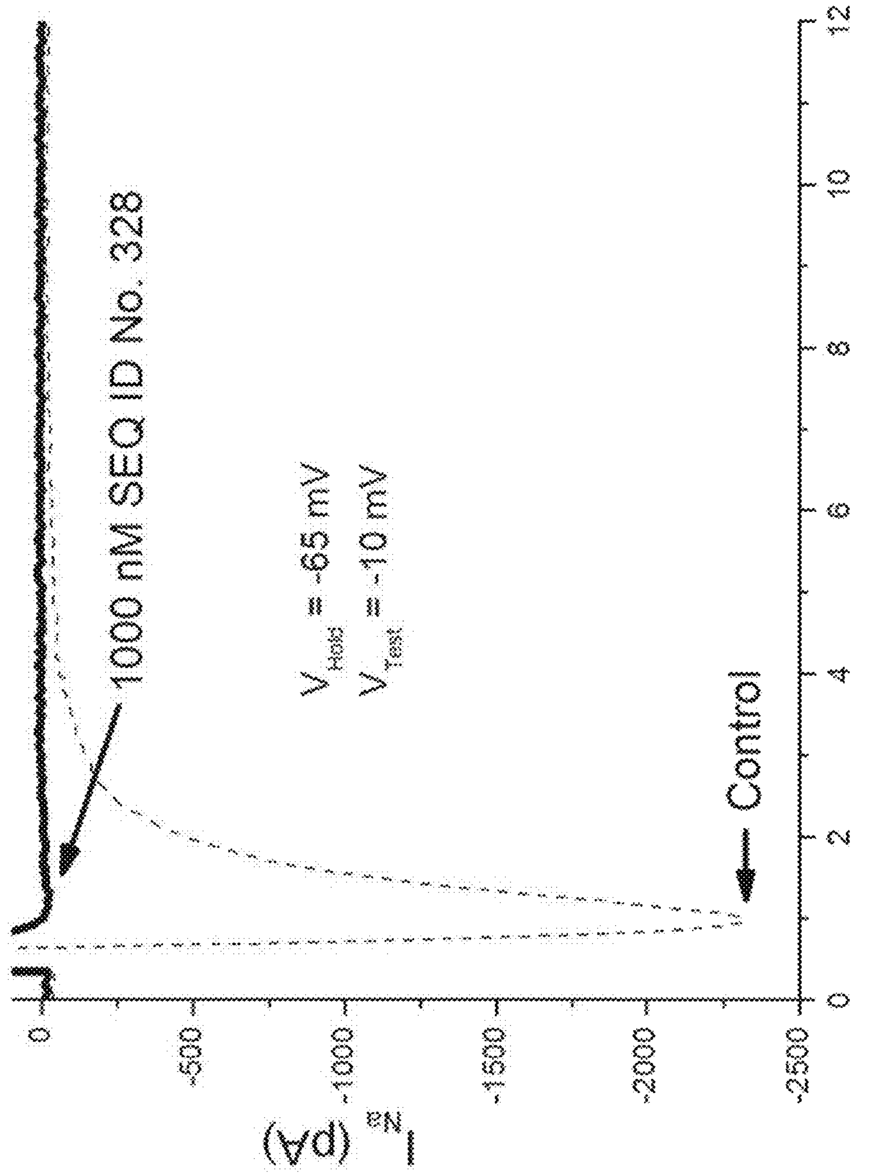
FIG. 117 shows the effect of Pra-[Nle6; Glu28]JzTx-V (1-29) (Seq ID No. 328) on human Nav1.2 Na channels expressed in HEK293 cells. Cell was held at −65 mV and peak inward Nav currents were measured at −10 mV. 'Control' trace shows Nav current before Seq ID No. 328, and '1000 nM Seq ID No. 328' trace shows Nav current after Seq ID No. 328 addition. Note that 1000 nM Pra-[Nle6; Glu28]JzTx-V(1-29) (Seq ID No. 328) blocks the majority of Nav current.
Figure 118:
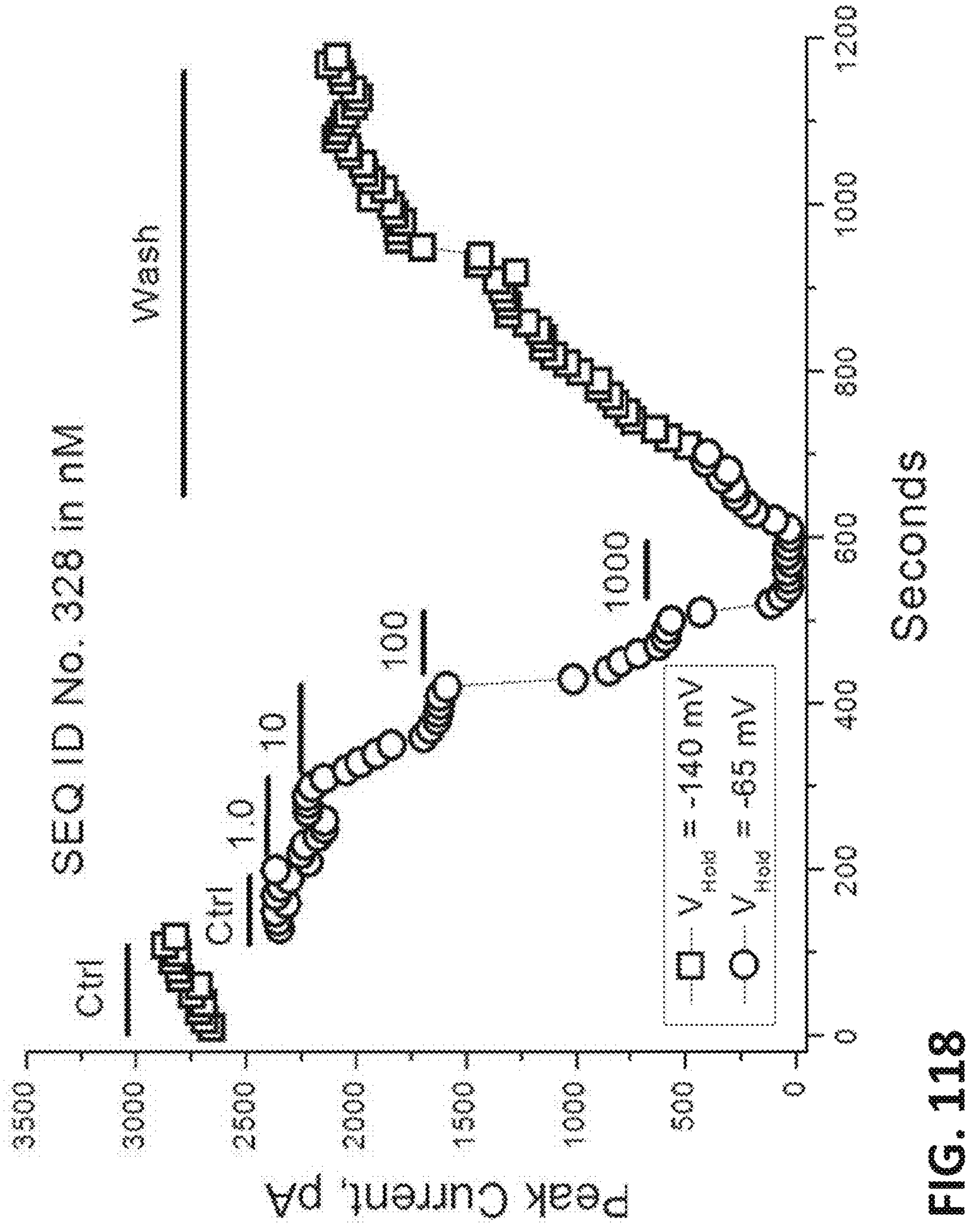
FIG. 118 shows the time course of increasing concentrations of Pra-[Nle6; Glu28]JzTx-V(1-29) (Seq ID No. 328) against human Nav1.2 Na channels expressed in HEK293 cells. Peak inward Nav currents were measured at −10 mV every 10 seconds in the presence of increasing concentrations of Pra-[Nle6; Glu28]JzTx-V(1-29) (Seq ID No. 328); cell was held at either −140 mV (squares), a voltage where Nav channels are completely non-inactivated, or −65 mV (circles), a voltage that yields approximately 20% inactivation. 'Ctrl' indicates Nav current in the absence of Seq ID No. 328 and 'Wash' indicates Nav current following removal of Pra-[Nle6; Glu28]JzTx-V(1-29) (Seq ID No. 328).
Figure 119:
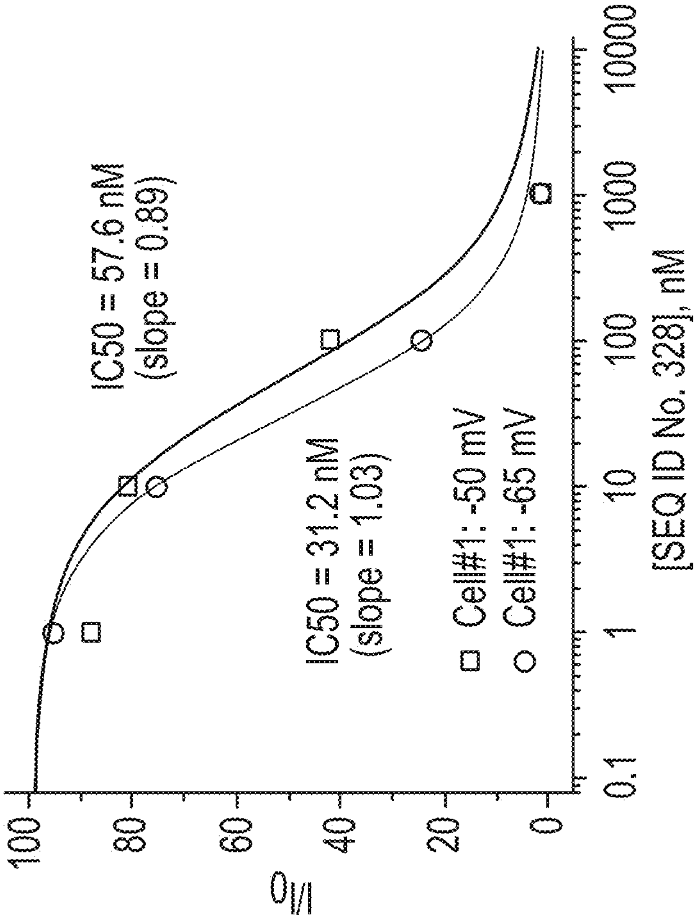
FIG. 119 shows the dose-response curves of Pra-[Nle6; Glu28]JzTx-V(1-29) (Seq ID No. 328) against human Nav1.2 Na channels in two separate HEK293 cells. Peak inward Nav currents were measured at −10 mV in the presence of increasing concentrations of Pra-[Nle6; Glu28] JzTx-V(1-29) (Seq ID No. 328) and divided by current before Seq ID No. 328 addition ($I/I_0$); cells were held at a voltage that yielded approximately 20% inactivation.

Particularly useful half-life extending moieties include immunoglobulins (e.g., human immunoglobulin, including IgG1, IgG2, IgG3 or IgG4). The term "immunoglobulin" encompasses full antibodies comprising two dimerized heavy chains (HC), each covalently linked to a light chain (LC); a single undimerized immunoglobulin heavy chain and covalently linked light chain (HC+LC); or a chimeric immunoglobulin (light chain+heavy chain)-Fc heterotrimer (a so-called "hemibody"). FIGS. 94A-N illustrate several different embodiments of such immunoglobulin-toxin peptide conjugates.

Recombinant fusion or chemical conjugation of the inventive JzTx-V peptide analogs to a recombinant immunoglobulin of any of the IgG1, IgG2, IgG3 or IgG4 isotypes can be useful to extend pharmacokinetic half life. (See, e.g., Doellgast et al., WO 2010/108153 A2). Any of the carrier immunoglobulins disclosed in Doellgast et al., WO 2010/108153 A2 or Walker et al., PCT/US2011/052841, or isotype conversions of any of them comprising different isotype constant domains, or other carrier immunoglobulins known in the art, can be used as half life extending moieties within the scope of the invention. For example, aglycosylated (e.g., N297G variant IgG1; Dennis et al., Low affinity blood brain barrier receptor antibodies and uses thereof, WO 2012/075037 A1) and/or cysteine-substituted ("CysMab") variant immunoglobulin monomers can also be employed for enhanced stability or modified effector function. (See, e.g., Table 5A below).

One example of a human IgG2 heavy chain (HC) constant domain has the amino acid sequence:

SEQ. ID NO: 533

ASTKGPSVFPLAPCSRSTSESTAALGCLVKDYFPEPVTVSWNSGALT

SGVHTFPAVLQSSGLYSLSSVVTVPSSNFGTQTYTCNVDHKPSNTKV

DKTVERKCCVECPPCPAPPVAGPSVFLFPPKPKDTLMISRTPEVTCV

VVDVSHEDPEVQFNWYVDGVEVHNAKTKPREEQFNSTFRVVSVLTVV

HQDWLNGKEYKCKVSNKGLPAPIEKTISKTKGQPREPQVYTLPPSRE

EMTKNQVSLTCLVKGFYPSDIAVEWESNGQPENNYKTTPPMLDSDGS

FFLYSKLTVDKSRWQQGNVFSCSVMHEALHNHYTQKSLSLSPGK//.

Constant region sequences of other IgG isotypes are known in the art for an IgG1, IgG2, IgG3, or IgG4 immunoglobulin isotype, if desired. In general, human IgG2 can be used for targets where effector functions are not desired, and human IgG1 in situations where such effector functions (e.g., antibody-dependent cytotoxicity (ADCC)) are desired. Human IgG3 has a relatively short half life and human IgG4 forms antibody "half-molecules." There are four known allotypes of human IgG1. The preferred allotype is referred to as "hIgG1z", also known as the "KEEM" allotype. Human IgG1 allotypes "hIgG1za" (KDEL), "hIgG1f" (REEM), and "hIgG1fa" are also useful; all appear to have ADCC effector function.

Human hIgG1z heavy chain (HC) constant domain has the amino acid sequence:

SEQ ID NO: 534

ASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKV

DKKVEPKSCDKTHTCPPCPAPELLGGPSVFLFPPKPKDTLMISRTPE

VTCVVVDVSHEDPEVKFNWYVDGVEVHNAKTKPREEQYNSTYRVVSV

LTVLHQDWLNGKEYKCKVSNKALPAPIEKTISKAKGQPREPQVYTLP

PSREEMTKNQVSLTCLVKGFYPSDIAVEWESNGQPENNYKTTPPVLD

SDGSFFLYSKLTVDKSRWQQGNVFSCSVMHEALHNHYTQKSLSLSPG

K//.

Human hIgG1za heavy chain (HC) constant domain has the amino acid sequence:

SEQ ID NO: 535

ASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKV

DKKVEPKSCDKTHTCPPCPAPELLGGPSVFLFPPKPKDTLMISRTPE

VTCVVVDVSHEDPEVKFNWYVDGVEVHNAKTKPREEQYNSTYRVVSV

LTVLHQDWLNGKEYKCKVSNKALPAPIEKTISKAKGQPREPQVYTLP

PSRDELTKNQVSLTCLVKGFYPSDIAVEWESNGQPENNYKTTPPVLD

SDGSFFLYSKLTVDKSRWQQGNVFSCSVMHEALHNHYTQKSLSLSPG

K//.

Human hIgG1f heavy chain (HC) constant domain has the amino acid sequence:

SEQ ID NO: 536

ASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKV

DKRVEPKSCDKTHTCPPCPAPELLGGPSVFLFPPKPKDTLMISRTPE

VTCVVVDVSHEDPEVKFNWYVDGVEVHNAKTKPREEQYNSTYRVVSV

LTVLHQDWLNGKEYKCKVSNKALPAPIEKTISKAKGQPREPQVYTLP

PSREEMTKNQVSLTCLVKGFYPSDIAVEWESNGQPENNYKTTPPVLD

SDGSFFLYSKLTVDKSRWQQGNVFSCSVMHEALHNHYTQKSLSLSPG

K//.

Human hIgG1fa heavy chain (HC) constant domain has the amino acid sequence:

SEQ ID NO: 537

ASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKV

DKRVEPKSCDKTHTCPPCPAPELLGGPSVFLFPPKPKDTLMISRTPE

VTCVVVDVSHEDPEVKFNWYVDGVEVHNAKTKPREEQYNSTYRVVSV

LTVLHQDWLNGKEYKCKVSNKALPAPIEKTISKAKGQPREPQVYTLP

PSRDELTKNQVSLTCLVKGFYPSDIAVEWESNGQPENNYKTTPPVLD

SDGSFFLYSKLTVDKSRWQQGNVFSCSVMHEALHNHYTQKSLSLSPG

K//.

One example of a human immunoglobulin light chain (LC) constant region sequence is the following (designated "CL-1"):

SEQ ID NO: 538

GQPKANPTVTLFPPSSEELQANKATLVCLISDFYPGAVTVAWKADGS

PVKAGVETTKPSKQSNNKYAASSYLSLTPEQWKSHRSYSCQVTHEGS

TVEKTVAPTECS//.

CL-1 is useful to increase the pI of antibodies and is convenient. There are three other human immunoglobulin light chain constant regions, designated "CL-2", "CL-3" and "CL-7", which can also be used within the scope of the present invention. CL-2 and CL-3 are more common in the human population.

CL-2 human light chain (LC) constant domain has the amino acid sequence:

SEQ ID NO: 539
GQPKAAPSVTLFPPSSEELQANKATLVCLISDFYPGAVTVAWKADSS

PVKAGVETTTPSKQSNNKYAASSYLSLTPEQWKSHRSYSCQVTHEGS

TVEKTVAPTECS//.

CL-3 human LC constant domain has the amino acid sequence:

SEQ ID NO: 540
GQPKAAPSVTLFPPSSEELQANKATLVCLISDFYPGAVTVAWKADSSP

VKAGVETTTPSKQSNNKYAASSYLSLTPEQWKSHKSYSCQVTHEGSTV

EKTVAPTECS//.

CL-7 human LC constant domain has the amino acid sequence:

SEQ ID NO: 541
GQPKAAPSVTLFPPSSEELQANKATLVCLVSDFYPGAVTVAWKADGSP

VKVGVETTKPSKQSNNKYAASSYLSLTPEQWKSHRSYSCRVTHEGSTV

EKTVAPAECS//.

TABLE 5A

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| 1695 | D70C, Light Chain sequence | EIVLTQSPGTLSLSPGERATLSCRASQGISRSELAWYQQKPGQAPSLLIY GASSRATGIPDRFSGSGSGTCFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1696 | V110C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTCAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1697 | A112C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVACPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1698 | A89C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1699 | A119C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1700 | S125C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1701 | E153C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1702 | D266C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| 1703 | E273C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1704 | Y301C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1705 | E346C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1706 | M359C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1707 | T360C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1708 | N362C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1709 | Q363C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1710 | E389C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1711 | N391C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1712 | D414C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1713 | S416C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |
| 1714 | S443C, Light Chain sequence | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSGTASVVCLLNNFYPREAKVQWK VDNALQSGNSQESVTEQDSKDSTYSLSSTLTLSKADYEKHKVYACEVTHQ GLSSPVTKSFNRGEC |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| 1715 | D70C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1716 | V110C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1717 | A112C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1718 | A89C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTA**C**DTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1719 | A119C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSS**C**STKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1720 | S125C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGP**C**VFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1721 | E153C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFP**C**PVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| | | Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1722 | D266C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVV**C**VSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1723 | E273C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDP**C**VKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1724 | Y301C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**ST**C**RVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1725 | E346C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPR**C**<br>PQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1726 | M359C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREE**C**TKNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1727 | T360C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEM**C**KNQVSLTCLVKGFYPSDIAVEWESNGQPENNYKTTP<br>PVLDSDGSFFLYSKLTVDKSRWQQGNVFSCSVMHEALHNHYTQKSLSLSP<br>GK |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| 1728 | N362C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTK**C**QVSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1729 | Q363C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKN**C**VSLTCLVKGFYPSDIAVEWESNGQPENNYKTTP<br>PVLDSDGSFFLYSKLTVDKSRWQQGNVFSCSVMHEALHNHYTQKSLSLSP<br>GK |
| 1730 | E389C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQP**C**NNYKTTP<br>PVLDSDGSFFLYSKLTVDKSRWQQGNVFSCSVMHEALHNHYTQKSLSLSP<br>GK |
| 1731 | N391C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPEN**C**YKTTP<br>PVLDSDGSFFLYSKLTVDKSRWQQGNVFSCSVMHEALHNHYTQKSLSLSP<br>GK |
| 1732 | D414C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTV**C**KSRWQQGNVFSCSVMHEALHNHYTQKSLSLSP<br>GK |
| 1733 | S416C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ<br>Y**G**STYRVVSVLTVLHQDWLNGKEYKCKVSNKALPAPIEKTISKAKGQPRE<br>PQVYTLPPSREEMTKNQVSLTCLVKGFYPSDIAVEWESNGQPENNYKTTP<br>PVLDSDGSFFLYSKLTVDK**C**RWQQGNVFSCSVMHEALHNHYTQKSLSLSP<br>GK |
| 1734 | S443C, Heavy Chain sequence | QVQLQESGPGLVKPSQTLSLTCTVSGGSISSGDYFWSWIRQLPGKGLEWI<br>GHIHNSGTTYYNPSLKSRVTISVDTSKKQFSLRLSSVTAADTAVYYCARD<br>RGGDYAYGMDVWGQGTTVTVSSASTKGPSVFPLAPSSKSTSGGTAALGCL<br>VKDYFPEPVTVSWNSGALTSGVHTFPAVLQSSGLYSLSSVVTVPSSSLGT<br>QTYICNVNHKPSNTKVDKRVEPKSCDKTHTCPPCPAPELLGGPSVFLFPP<br>KPKDTLMISRTPEVTCVVVDVSHEDPEVKFNWYVDGVEVHNAKTKPREEQ |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| | | YGSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLCLSP GK |
| 1735 | hu Fc SEFL E346C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPRCPQVYTLPPSREEMTKNQVSLTCLVK GFYPSDIAVEWESNGQPENNYKTTPPVLDSDGSFFLYSKLTVDKSRWQQG NVFSCSVMHEALHNHYTQKSLSLSPGK |
| 1736 | hu Fc SEFL N362C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPREPQVYTLPPSREEMTKCQVSLTCLVK GFYPSDIAVEWESNGQPENNYKTTPPVLDSDGSFFLYSKLTVDKSRWQQG NVFSCSVMHEALHNHYTQKSLSLSPGK |
| 1737 | hu Fc SEFL Q363C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPREPQVYTLPPSREEMTKNCVSLTCLVK GFYPSDIAVEWESNGQPENNYKTTPPVLDSDGSFFLYSKLTVDKSRWQQG NVFSCSVMHEALHNHYTQKSLSLSPGK |
| 1738 | hu Fc SEFL N391C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPREPQVYTLPPSREEMTKNQVSLTCLVK GFYPSDIAVEWESNGQPENCYKTTPPVLDSDGSFFLYSKLTVDKSRWQQG NVFSCSVMHEALHNHYTQKSLSLSPGK |
| 1739 | hu Fc SEFL L399C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPREPQVYTLPPSREEMTKNQVSLTCLVK GFYPSDIAVEWESNGQPENNYKTTPPVCDSDGSFFLYSKLTVDKSRWQQG NVFSCSVMHEALHNHYTQKSLSLSPGK |
| 1740 | hu Fc SEFL D414C | DKTHTCPPCPAPELLGGPSVFLFPPKPKDTLMISRTPEVTCVVVDVSHED PEVKFNWYVDGVEVHNAKTKPREEQYGSTYRVVSVLTVLHQDWLNGKEYK CKVSNKALPAPIEKTISKAKGQPREPQVYTLPPSREEMTKNQVSLTCLVK GFYPSDIAVEWESNGQPENNYKTTPPVLDSDGSFFLYSKLTVCKSRWQQG NVFSCSVMHEALHNHYTQKSLSLSPGK |
| 1741 | T360C, non-SEFL Fc sequence | DKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYK CKVSNKALPAPIEKTISKAKGQPREPQVYTLPPSREEMCKNQVSLTCLVK GFYPSDIAVEWESNGQPENNYKTTPPVLDSDGSFFLYSKLTVDKSRWQQG NVFSCSVMHEALHNHYTQKSLSLSPGK |
| 1742 | D70C, non-SEFL Heavy Chain sequence | QVQLQESGPGLVKPSQTLSLTCTVSGGSISSGDYFWSWIRQLPGKGLEWI GHIHNSGTTYYNPSLKSRVTISVDTSKKQFSLRLSSVTAADTAVYYCARD RGGDYAYGMDVWGQGTTVTVSSASTKGPSVFPLAPSSKSTSGGTAALGCL VKDYFPEPVTVSWNSGALTSGVHTFPAVLQSSGLYSLSSVVTVPSSSLGT QTYICNVNHKPSNTKVDKRVEPKSCDKTHTCPPCPAPELLGGPSVFLFPP KPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSP GK |
| 1743 | A89C, non-SEFL Heavy Chain Sequence | QVQLQESGPGLVKPSQTLSLTCTVSGGSISSGDYFWSWIRQLPGKGLEWI GHIHNSGTTYYNPSLKSRVTISVDTSKKQFSLRLSSVTACDTAVYYCARD RGGDYAYGMDVWGQGTTVTVSSAVSWNSGALTSGVHTFPAVLQSSGLYSL SSVVTVPSSSLGTQTYICNVNHKPSNTKVDKRVEPKSCDKTHTCPPCPAP ELLSTKGPSVFPLAPSSKSTSGGTAALGCLVKDYFPEPVTGGPSVFLFPP KPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSP GK |
| 1744 | A89C, non-SEFL Light Chain | EIVLTQSPGTLSLSPGERATLSCRASQGISRSELAWYQQKPGQAPSLLIY GASSRATGIPDRFSGSGSGTDFTLTISRLEPEDFAVYYCQQFGSSPWTFG QGTKVEIKRTVAAPSVFIFPPSDEQLKSQESVTEQDSKDSTYSLSSTLTL |

TABLE 5A-continued

Modified Human Immunoglobulin Light Chain, Heavy Chain, and Fc Monomer Sequences that are Useful Components for Half-life Extending Moieties.

| SEQ ID NO: | Designation | Amino Acid Sequence |
|---|---|---|
| | sequence | SKADYEKHKVYACEVTHQGLSSPVTKSFNRGECGTASVVCLLNNFYPREA KVQWKVDNALQSGNS |

Variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope or domain on the target protein, if any. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, *J. Mol. Biol.* 196:901-917; Chothia et al., 1989, *Nature* 342: 878-883.

An "antibody", or interchangeably "Ab", is a tetrameric immunoglobulin protein. In a naturally-occurring antibody, which is typically a glycoprotein, each tetramer is composed of two identical pairs of polypeptide chains, each pair having one "light" chain of about 220 amino acids (about 25 kDa) and one "heavy" chain of about 440 amino acids (about 50-70 kDa). The amino-terminal portion of each chain includes a "variable" ("V") region of about 100 to 110 or more amino acids primarily responsible for antigen recognition. The carboxy-terminal portion of each chain defines a constant region primarily responsible for effector function. The variable region differs among different antibodies. The constant region is the same among different antibodies. Within the variable region of each heavy or light chain, there are three hypervariable subregions that help determine the antibody's specificity for antigen. The variable domain residues between the hypervariable regions are called the framework residues and generally are somewhat homologous among different antibodies. Immunoglobulins can be assigned to different classes depending on the amino acid sequence of the constant domain of their heavy chains. Human light chains are classified as kappa (κ) and lambda (λ) light chains. Within light and heavy chains, the variable and constant regions are joined by a "J" region of about 12 or more amino acids, with the heavy chain also including a "D" region of about 10 more amino acids. See generally, Fundamental Immunology, Ch. 7 (Paul, W., ed., 2nd ed. Raven Press, N.Y. (1989)). Within the scope of the invention, an "antibody" also encompasses a recombinantly made antibody, and antibodies that are lacking glycosylation. (See, e.g., Jung et al., *Bypassing glycosylation: engineering aglycosylated full-length IgG antibodies for human therapy*, Current Opinion in Biotechnology 22:858-867 (2011); Lazar et al., *Optimized Fc Variants and Methods for Their Generation*, WO2004/099249 A2)

The term "light chain" or "immunoglobulin light chain" includes a full-length light chain and fragments thereof having sufficient variable region sequence to confer binding specificity. A full-length light chain includes a variable region domain, VL, and a constant region domain, CL. The variable region domain of the light chain is at the amino-terminus of the polypeptide. Light chains include kappa chains and lambda chains. The term "heavy chain" or "immunoglobulin heavy chain" includes a full-length heavy chain and fragments thereof having sufficient variable region sequence to confer binding specificity. A full-length heavy chain includes a variable region domain, $V_H$, and three constant region domains, $C_H1$, $C_H2$, and $C_H3$. The $V_H$ domain is at the amino-terminus of the polypeptide, and the $C_H$ domains are at the carboxyl-terminus, with the $C_H3$ being closest to the carboxy-terminus of the polypeptide. Heavy chains are classified as mu (μ), delta (Δ), gamma (γ), alpha (α), and epsilon (ε), and define the antibody's isotype as IgM, IgD, IgG, IgA, and IgE, respectively. In separate embodiments of the invention, heavy chains may be of any isotype, including IgG (including IgG1, IgG2, IgG3 and IgG4 subtypes), IgA (including IgA1 and IgA2 subtypes), IgM and IgE. Several of these may be further divided into subclasses or isotypes, e.g. IgG1, IgG2, IgG3, IgG4, IgA1 and IgA2. The variable regions of each light/heavy chain pair typically form the antigen binding site of an antibody, but a useful carrier antibody need not have a known antigen binding site to be useful. (See, e.g., Doellgast et al., WO 2010/108153 A2; Walker et al., PCT/US2011/052841). Different IgG isotypes may have different effector functions (mediated by the Fc region), such as antibody-dependent cellular cytotoxicity (ADCC) and complement-dependent cytotoxicity (CDC). In ADCC, the Fc region of an antibody binds to Fc receptors (FcγRs) on the surface of immune effector cells such as natural killers and macrophages, leading to the phagocytosis or lysis of the targeted cells. In CDC, the antibodies kill the targeted cells by triggering the complement cascade at the cell surface.

An "Fe region", or used interchangeably herein, "Fe domain" or "immunoglobulin Fc domain", contains two heavy chain fragments, which in a full antibody comprise the $C_H1$ and $C_H2$ domains of the antibody. The two heavy chain fragments are held together by two or more disulfide bonds and by hydrophobic interactions of the $C_H3$ domains.

The term "salvage receptor binding epitope" refers to an epitope of the Fc region of an IgG molecule (e.g., $IgG_1$, $IgG_2$, $IgG_3$, or $IgG_4$) that is responsible for increasing the in vivo serum half-life of the IgG molecule.

"Allotypes" are variations in antibody sequence, often in the constant region, that can be immunogenic and are encoded by specific alleles in humans. Allotypes have been identified for five of the human IGHC genes, the IGHG1, IGHG2, IGHG3, IGHA2 and IGHE genes, and are designated as G1m, G2m, G3m, A2m, and Em allotypes, respectively. At least 18 Gm allotypes are known: nG1m(1), nG1m(2), G1m (1, 2, 3, 17) or G1m (a, x, f, z), G2m (23) or G2m (n), G3m (5, 6, 10, 11, 13, 14, 15, 16, 21, 24, 26, 27, 28) or G3m (b1, c3, b5, b0, b3, b4, s, t, g1, c5, u, v, g5). There are two A2m allotypes A2m(1) and A2m(2).

For a detailed description of the structure and generation of antibodies, see Roth, D. B., and Craig, N. L., *Cell,* 94:411-414 (1998), herein incorporated by reference in its entirety. Briefly, the process for generating DNA encoding the heavy and light chain immunoglobulin sequences occurs primarily in developing B-cells. Prior to the rearranging and joining of various immunoglobulin gene segments, the V, D, J and constant (C) gene segments are found generally in relatively close proximity on a single chromosome. During B-cell-differentiation, one of each of the appropriate family members of the V, D, J (or only V and J in the case of light chain genes) gene segments are recombined to form functionally rearranged variable regions of the heavy and light immunoglobulin genes. This gene segment rearrangement process appears to be sequential. First, heavy chain D-to-J joints are made, followed by heavy chain V-to-DJ joints and light chain V-to-J joints. In addition to the rearrangement of V, D and J segments, further diversity is generated in the primary repertoire of immunoglobulin heavy and light chains by way of variable recombination at the locations where the V and J segments in the light chain are joined and where the D and J segments of the heavy chain are joined. Such variation in the light chain typically occurs within the last codon of the V gene segment and the first codon of the J segment. Similar imprecision in joining occurs on the heavy chain chromosome between the D and $J_H$ segments and may extend over as many as 10 nucleotides. Furthermore, several nucleotides may be inserted between the D and $J_H$ and between the $V_H$ and D gene segments which are not encoded by genomic DNA. The addition of these nucleotides is known as N-region diversity. The net effect of such rearrangements in the variable region gene segments and the variable recombination which may occur during such joining is the production of a primary antibody repertoire.

The term "hypervariable" region refers to the amino acid residues of an antibody which are responsible for antigen-binding. The hypervariable region comprises amino acid residues from a complementarity determining region or CDR [i.e., residues 24-34 (L1), 50-56 (L2) and 89-97 (L3) in the light chain variable domain and 31-35 (H1), 50-65 (H2) and 95-102 (H3) in the heavy chain variable domain as described by Kabat et al., Sequences of Proteins of Immunological Interest, $5^{th}$ Ed. Public Health Service, National Institutes of Health, Bethesda, Md. (1991)]. Even a single CDR may recognize and bind antigen, although with a lower affinity than the entire antigen binding site containing all of the CDRs.

An alternative definition of residues from a hypervariable "loop" is described by Chothia et al., *J. Mol. Biol.* 196: 901-917 (1987) as residues 26-32 (L1), 50-52 (L2) and 91-96 (L3) in the light chain variable domain and 26-32 (H1), 53-55 (H2) and 96-101 (H3) in the heavy chain variable domain.

"Framework" or "FR" residues are those variable region residues other than the hypervariable region residues.

"Antibody fragments" comprise a portion of an intact full length antibody, preferably the antigen binding or variable region of the intact antibody. Examples of antibody fragments include Fab, Fab', $F(ab')_2$, and Fv fragments; diabodies; linear antibodies (Zapata et al., Protein Eng., 8(10): 1057-1062 (1995)); single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment which contains the constant region. The Fab fragment contains all of the variable domain, as well as the constant domain of the light chain and the first constant domain (CH1) of the heavy chain. The Fc fragment displays carbohydrates and is responsible for many antibody effector functions (such as binding complement and cell receptors), that distinguish one class of antibody from another.

Pepsin treatment yields an $F(ab')_2$ fragment that has two "Single-chain Fv" or "scFv" antibody fragments comprising the VH and VL domains of antibody, wherein these domains are present in a single polypeptide chain. Fab fragments differ from Fab' fragments by the inclusion of a few additional residues at the carboxy terminus of the heavy chain CH1 domain including one or more cysteines from the antibody hinge region. Preferably, the Fv polypeptide further comprises a polypeptide linker between the VH and VL domains that enables the Fv to form the desired structure for antigen binding. For a review of scFv see Pluckthun in The Pharmacology of Monoclonal Antibodies, vol. 113, Rosenburg and Moore eds., Springer-Verlag, New York, pp. 269-315 (1994).

A "Fab fragment" is comprised of one light chain and the $C_H1$ and variable regions of one heavy chain. The heavy chain of a Fab molecule cannot form a disulfide bond with another heavy chain molecule.

A "Fab' fragment" contains one light chain and a portion of one heavy chain that contains the $V_H$ domain and the $C_H1$ domain and also the region between the $C_H1$ and $C_H2$ domains, such that an interchain disulfide bond can be formed between the two heavy chains of two Fab' fragments to form an $F(ab')_2$ molecule.

A "$F(ab')_2$ fragment" contains two light chains and two heavy chains containing a portion of the constant region between the $C_H1$ and $C_H2$ domains, such that an interchain disulfide bond is formed between the two heavy chains. A $F(ab')_z$ fragment thus is composed of two Fab' fragments that are held together by a disulfide bond between the two heavy chains.

"Fv" is the minimum antibody fragment that contains a complete antigen recognition and binding site. This region consists of a dimer of one heavy- and one light-chain variable domain in tight, non-covalent association. It is in this configuration that the three CDRs of each variable domain interact to define an antigen binding site on the surface of the VH VL dimer. A single variable domain (or half of an Fv comprising only three CDRs specific for an antigen) has the ability to recognize and bind antigen, although at a lower affinity than the entire binding site.

"Single-chain antibodies" are Fv molecules in which the heavy and light chain variable regions have been connected by a flexible linker to form a single polypeptide chain, which forms an antigen-binding region. Single chain antibodies are discussed in detail in International Patent Application Publication No. WO 88/01649 and U.S. Pat. Nos. 4,946,778 and 5,260,203, the disclosures of which are incorporated by reference in their entireties.

"Single-chain Fv" or "scFv" antibody fragments comprise the $V_H$ and $V_L$ domains of antibody, wherein these domains are present in a single polypeptide chain, and optionally comprising a polypeptide linker between the $V_H$ and $V_L$ domains that enables the Fv to form the desired structure for antigen binding (Bird et al., Science 242:423-426, 1988, and Huston et al., *Proc. Natl. Acad. Sci. USA* 85:5879-5883, 1988). An "Fd" fragment consists of the $V_H$ and $C_H1$ domains.

The term "diabodies" refers to small antibody fragments with two antigen-binding sites, which fragments comprise a heavy-chain variable domain (VH) connected to a light-chain variable domain (VL) in the same polypeptide chain (VH VL). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90:6444-6448 (1993).

A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody may target the same or different antigens.

The term "epitope" is the portion of a molecule that is bound by an antigen binding protein (for example, an antibody). The term includes any determinant capable of specifically binding to an antigen binding protein, such as an antibody or to a T-cell receptor. An epitope can be contiguous or non-contiguous (e.g., in a single-chain polypeptide, amino acid residues that are not contiguous to one another in the polypeptide sequence but that within the context of the molecule are bound by the antigen binding protein). In certain embodiments, epitopes may be mimetic in that they comprise a three dimensional structure that is similar to an epitope used to generate the antigen binding protein, yet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antibodies specific for a particular target antigen will preferentially recognize an epitope on the target antigen in a complex mixture of proteins and/or macromolecules.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York: Academic Press; Sequence Analysis Primer, (Gribskov, M. and Devereux, J., eds.), 1991, New York: M. Stockton Press; and Carillo et al., 1988, SIAM J. Applied Math. 48:1073. For example, sequence identity can be determined by standard methods that are commonly used to compare the similarity in position of the amino acids of two polypeptides. Using a computer program such as BLAST or FASTA, two polypeptide or two polynucleotide sequences are aligned for optimal matching of their respective residues (either along the full length of one or both sequences, or along a pre-determined portion of one or both sequences). The programs provide a default opening penalty and a default gap penalty, and a scoring matrix such as PAM 250 [a standard scoring matrix; see Dayhoff et al., in *Atlas of Protein Sequence and Structure*, vol. 5, supp. 3 (1978)] can be used in conjunction with the computer program. For example, the percent identity can then be calculated as: the total number of identical matches multiplied by 100 and then divided by the sum of the length of the longer sequence within the matched span and the number of gaps introduced into the longer sequences in order to align the two sequences. In calculating percent identity, the sequences being compared are aligned in a way that gives the largest match between the sequences.

The GCG program package is a computer program that can be used to determine percent identity, which package includes GAP (Devereux et al., 1984, Nucl. Acid Res. 12:387; Genetics Computer Group, University of Wisconsin, Madison, Wis.). The computer algorithm GAP is used to align the two polypeptides or two polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix; Henikoff et al., 1992, Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program include the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences may result in matching of only a short region of the two sequences, and this small aligned region may have very high sequence identity even though there is no significant relationship between the two full-length sequences. Accordingly, the selected alignment method (GAP program) can be adjusted if so desired to result in an alignment that spans at least 50 contiguous amino acids of the target polypeptide.

The term "modification" when used in connection with immmunoglobulins, including antibodies and antibody fragments, of the invention, include, but are not limited to, one or more amino acid changes (including substitutions, insertions or deletions); chemical modifications; covalent modification by conjugation to therapeutic or diagnostic agents; labeling (e.g., with radionuclides or various enzymes); covalent polymer attachment such as PEGylation (derivatization with polyethylene glycol) and insertion or substitution by chemical synthesis of non-natural amino acids.

The term "derivative" when used in connection with an immunoglobulin (including antibodies and antibody fragments) within the scope of the invention refers to immunoglobulin proteins that are covalently modified by conjugation to therapeutic or diagnostic agents, labeling (e.g., with radionuclides or various enzymes), covalent polymer attachment such as PEGylation (derivatization with polyethylene glycol) and insertion or substitution by chemical synthesis of non-natural amino acids. Derivatives of the invention will retain the binding properties of underivatized molecules of the invention.

In some embodiments of the invention, the half-life extending moiety is an immunoglobulin Fc domain (e.g., a human immunoglobulin Fc domain, including Fc of allotype IgG1, IgG2, IgG3 or IgG4) or a portion thereof (e.g., CH2 domain of the Fc domain), human serum albumin (HSA), or poly(ethylene glycol) (PEG), in particular PEG of molecular weight of about 1000 Da to about 100000 Da.

Monovalent dimeric or bivalent dimeric Fc-toxin peptide analog fusions or conjugates are useful embodiments of the inventive composition of matter. A "monovalent dimeric" Fc-toxin peptide analog fusion or conjugate, or interchangeably, "monovalent dimer", or interchangeably, "monovalent heterodimer", is a Fc-toxin peptide analog fusion or conjugate that includes a toxin peptide analog conjugated with only one of the dimerized Fc domains (e.g., as represented schematically in FIG. 2B of Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties). A "bivalent dimeric" Fc-toxin peptide analog fusion, or interchangeably, "bivalent dimer" or "bivalent homodimer", is a Fc-toxin peptide analog fusion or conjugate having both of the dimerized Fc domains each conjugated separately with a toxin peptide analog (e.g., as represented schematically in FIG. 2C of Sullivan et al., Toxin Peptide Therapeutic Agents, US2007/0071764 and Sullivan et al., Toxin Peptide Therapeutic Agents, PCT/US2007/022831, published as WO 2008/088422).

Immunoglobulin Fc domains include Fc variants, which are suitable half-life extending moieties within the scope of this invention. A native Fc can be extensively modified to form an Fc variant in accordance with this invention, provided binding to the salvage receptor is maintained; see, for example WO 97/34631, WO 96/32478, and WO 04/110 472. In such Fc variants, one can remove one or more sites of a native Fc that provide structural features or functional activity not required by the fusion or conjugate molecules of this invention. One can remove these sites by, for example, substituting or deleting residues, inserting residues into the site, or truncating portions containing the site. The inserted or substituted residues can also be altered amino acids, such as peptidomimetics or D-amino acids. Fc variants can be desirable for a number of reasons, several of which are described below. Exemplary Fc variants include molecules and sequences in which:

1. Sites involved in disulfide bond formation are removed. Such removal can avoid reaction with other cysteine-containing proteins present in the host cell used to produce the molecules of the invention. For this purpose, the cysteine-containing segment at the N-terminus can be truncated or cysteine residues can be deleted or substituted with other amino acids (e.g., alanyl, seryl). In particular, one can truncate the N-terminal 20-amino acid segment of SEQ ID NO: 478:

```
                                          SEQ ID NO: 478
Met Glu Trp Ser Trp Val Phe Leu Phe Phe Leu Ser

Val Thr Thr Gly Val His Ser Asp Lys Thr His Thr

Cys Pro Pro Cys Pro Ala Pro Glu Leu Leu Gly Gly

Pro Ser Val Phe Leu Phe Pro Pro Lys Pro Lys Asp

Thr Leu Met Ile Ser Arg Thr Pro Glu Val Thr Cys

Val Val Val Asp Val Ser His Glu Asp Pro Glu Val

Lys Phe Asn Trp Tyr Val Asp Gly Val Glu Val His

Asn Ala Lys Thr Lys Pro Arg Glu Glu Gln Tyr Asn

Ser Thr Tyr Arg Val Val Ser Val Leu Thr Val Leu

His Gln Asp Trp Leu Asn Gly Lys Glu Tyr Lys Cys

Lys Val Ser Asn Lys Ala Leu Pro Ala Pro Ile Glu

Lys Thr Ile Ser Lys Ala Lys Gly Gln Pro Arg Glu

Pro Gln Val Tyr Thr Leu Pro Pro Ser Arg Asp Glu

Leu Thr Lys Asn Gln Val Ser Leu Thr Cys Leu Val

Lys Gly Phe Tyr Pro Ser Asp Ile Ala Val Glu Trp

Glu Ser Asn Gly Gln Pro Glu Asn Asn Tyr Lys Thr

Thr Pro Pro Val Leu Asp Ser Asp Gly Ser Phe Phe

Leu Tyr Ser Lys Leu Thr Val Asp Lys Ser Arg Trp

Gln Gln Gly Asn Val Phe Ser Cys Ser Val Met His

Glu Ala Leu His Asn His Tyr Thr Gln Lys Ser Leu

Ser Leu Ser Pro Gly Lys//.
```

or delete or substitute the cysteine residues at positions 7 and 10 of SEQ ID NO: 478. Even when cysteine residues are removed, the single chain Fc domains can still form a dimeric Fc domain that is held together non-covalently.

2. A native Fc is modified to make it more compatible with a selected host cell. For example, one can remove the PA dipeptide sequence near the N-terminus of a typical native Fc, which can be recognized by a digestive enzyme in *E. coli* such as proline iminopeptidase. One can also add an N-terminal methionine residue, especially when the molecule is expressed recombinantly in a bacterial cell such as *E. coli*. The Fc domain of SEQ ID NO: 478 is one such Fc variant.

3. A portion of the N-terminus of a native Fc is removed to prevent N-terminal heterogeneity when expressed in a selected host cell. For this purpose, one can delete any of the first 20 amino acid residues at the N-terminus, particularly those at positions 1, 2, 3, 4 and 5.

4. One or more glycosylation sites are removed. Residues that are typically glycosylated (e.g., asparagine) can confer cytolytic response. Such residues can be deleted or substituted with unglycosylated residues (e.g., alanine).

5. Sites involved in interaction with complement, such as the C1q binding site, are removed. For example, one can delete or substitute the EKK tripeptide sequence of human IgG1. Complement recruitment may not be advantageous for the molecules of this invention and so can be avoided with such an Fc variant.

6. Sites are removed that affect binding to Fc receptors other than a salvage receptor. A native Fc can have sites for interaction with certain white blood cells that are not required for the fusion or conjugate molecules of the present invention and so can be removed.

7. The ADCC site is removed to decrease or eliminate ADCC effector function, or alternatively, modified for enhanced ADCC effector function by non-fucosylation or de-fucosylation. ADCC sites are known in the art; see, for example, *Molec. Immunol.* 29 (5): 633-9 (1992) with regard to ADCC sites in IgG1. These sites, as well, are not required for the fusion or conjugate molecules of the present invention and so can be removed, or enhanced for ADCC effector function, as may be desired. (See, Iida et al., Two mechanisms of the enhanced antibody-dependent cellular cytotoxicity (ADCC) efficacy of non-fucosylated therapeutic antibodies in human blood, BMC Cancer 9:58 doi:10.1186/1471-2407-9-58 (2009)).

8. When the native Fc is derived from a non-human antibody, the native Fc can be humanized. Typically, to humanize a native Fc, one will substitute selected residues in the non-human native Fc with residues that are normally found in human native Fc. Techniques for antibody humanization are well known in the art.

9. One or more toxin peptide analog sequences can be inserted into an internal conjugation site, or sites, within a loop region of an immunoglobulin Fc domain, as disclosed in U.S. Pat. Nos. 7,442,778; 7,645,861; 7,655,764; 7,655,765; 7,662,931; 7,750,127, and 7,750,128. The term "loop" region or "Fc-loop" region refers to a primary sequence of amino acid residues which connects two regions comprising secondary structure, such as an α-helix or a β-sheet, in the immediate N-terminal and C-terminal directions of primary structure from the loop region. Examples include, but are not limited to, CH2 or CH3 loop regions. One of skill in the art understands that a loop region, while not itself comprising secondary structure, may influence or contribute to secondary or higher order protein structure. The term "internal" conjugation site means that the toxin peptide analog moiety, or moieties, is non-terminal, i.e., not through the α-amino site or the α-carboxy site of the Fc domain, although there optionally can also be additional moieties conjugated terminally at the N-terminal and/or C-terminal of the Fc domain.

10. A linker of suitable length and neutral charge, such as "L25" (GGGGSGGGGSGGGGSGGGGSGGGGS; SEQ ID NO:493) or "L20" (GGGGSGGGGSGGGGSGGGGS; SEQ ID NO:477), can be covalently fused between the C-terminal of one monomer of an Fc domain and the N-terminal of a second Fc domain monomer, with a toxin peptide analog fused to the N-terminal of the first Fc domain monomer or the C-terminal of the second Fc domain monomer, or within a loop region of the first and/or second Fc domain monomer. Such a molecule can be recombinantly expressed in bacterial or mammalian cells to produce a variant "monovalent dimeric" Fc-toxin peptide analog fusion or conjugate with the typical disulfide bond formation between the Fc monomers. (See, e.g., Example 13 herein). Other examples of Fc variants include the following: In SEQ ID NO: 478, the leucine at position 15 can be substituted with glutamate; the glutamate at position 99, with alanine; and the lysines at positions 101 and 103, with alanines. In addition, phenyalanine residues can replace one or more tyrosine residues. For purposes of the invention, a variant Fc domain can also be part of a monomeric immunoglobulin heavy chain, an antibody, or a heterotrimeric hemibody (LC+HC+Fc).

An alternative half-life extending moiety would be a protein, polypeptide, peptide, antibody, antibody fragment, or small molecule (e.g., a peptidomimetic compound) capable of binding to a salvage receptor. For example, one could use as a half-life extending moiety a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "half-life extending moiety" and are within the scope of this invention. Such half-life extending moieties should be selected for increased half-life (e.g., by avoiding sequences recognized by proteases) and decreased immunogenicity (e.g., by favoring non-immunogenic sequences, as discovered in antibody humanization).

As noted above, polymer half-life extending moieties can also be used. Various means for attaching chemical moieties useful as half-life extending moieties are currently available, see, e.g., Patent Cooperation Treaty ("PCT") International Publication No. WO 96/11953, entitled "N-Terminally Chemically Modified Protein Compositions and Methods," herein incorporated by reference in its entirety. This PCT publication discloses, among other things, the selective attachment of water-soluble polymers to the N-terminus of proteins.

In some embodiments of the inventive compositions, the polymer half-life extending moiety is polyethylene glycol (PEG), covalently linked at the N-terminal, C-terminal or at one or more intercalary side chains of toxin peptide analog. Some embodiments of the inventive composition of matter further include one or more PEG moieties conjugated to a non-PEG half-life extending moiety or to the toxin peptide analog, or to any combination of any of these. For example, an Fc domain or portion thereof in the inventive composition can be made mono-PEGylated, di-PEGylated, or otherwise multi-PEGylated, by the process of reductive alkylation.

Covalent conjugation of proteins and peptides with poly (ethylene glycol) (PEG) has been widely recognized as an approach to significantly extend the in vivo circulating half-lives of therapeutic proteins. PEGylation achieves this effect predominately by retarding renal clearance, since the PEG moiety adds considerable hydrodynamic radius to the protein. (Zalipsky, S., et al., Use of functionalized poly (ethylene glycol)s for modification of polypeptides., in poly (ethylene glycol) chemistry: Biotechnical and biomedical applications., J. M. Harris, Ed., Plenum Press: New York., 347-370 (1992)). Additional benefits often conferred by PEGylation of proteins and peptides include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials.

By "PEGylated peptide" or "PEGylated protein" is meant a peptide having a polyethylene glycol (PEG) moiety covalently bound to an amino acid residue of the peptide itself or to a peptidyl or non-peptidyl linker that is covalently bound to a residue of the peptide, either directly or indirectly through another linker moiety. A non-limiting example is N-terminal conjugation of the peptide with 3-(1-(1-bromo-2-oxo-6,9,12,15,18,21,24,27,30,33,36-undecaoxa-3-azaoctatriacontan-38-yl)-1H-1,2,3-triazol-4-yl)propanoyl (designated herein by the abbreviation "{bromoacetamide-PEG11-triazole}-").

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with the present invention, useful PEG includes substantially linear, straight chain PEG, branched PEG (brPEG), or dendritic PEG. (See, e.g., Merrill, U.S. Pat. No. 5,171,264; Harris et al., Multiarmed, monofunctional, polymer for coupling to molecules and surfaces, U.S. Pat. No. 5,932,462; Shen, N-maleimidyl polymer derivatives, U.S. Pat. No. 6,602,498).

Figure 5:
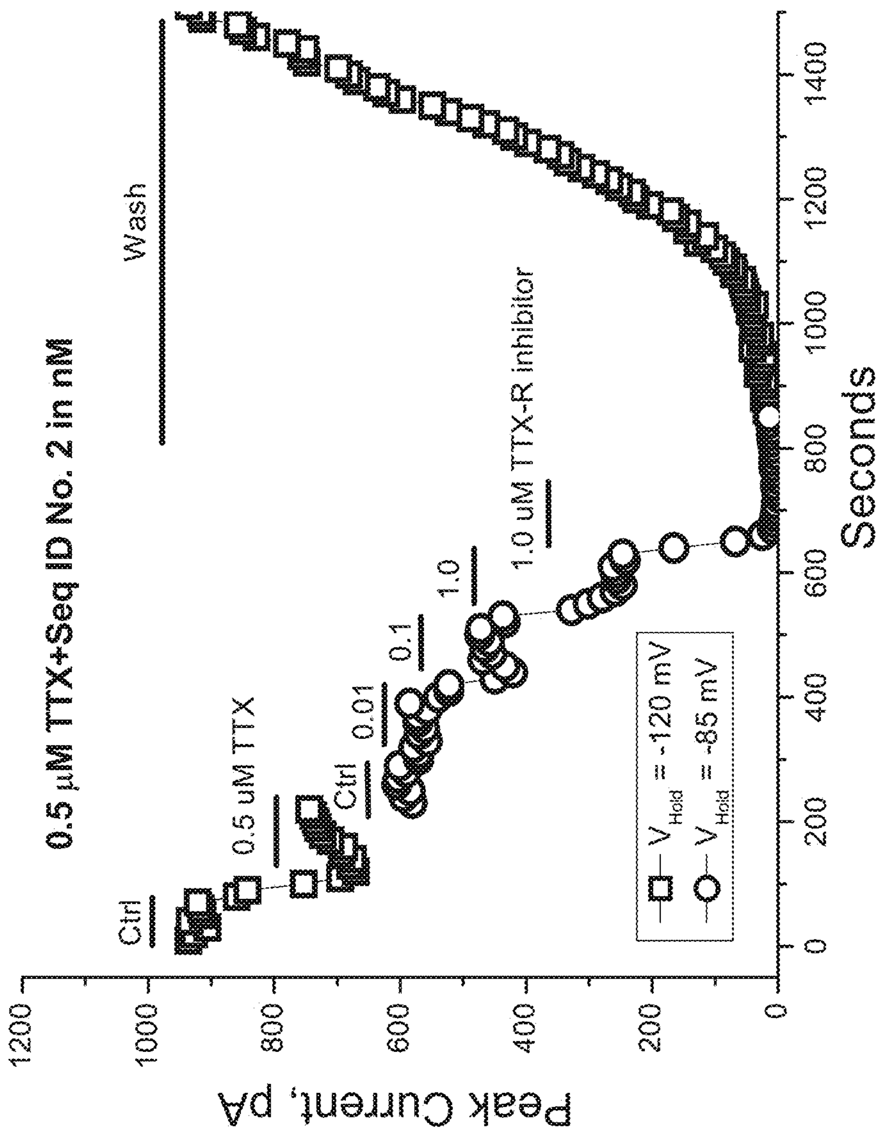
FIG. 5 shows the time course of increasing concentrations of JzTx-V(1-29) (SEQ ID NO:2) against hNav1.8 channels in inducible CHO cell. Peak inward Nav currents were measured at 0 mV every 10 seconds in the presence of increasing concentrations of JzTx-V(1-29) (SEQ ID NO:2); cell was held at either −120 mV (squares) or −85 mV (circles). "Ctrl" indicates Nav current in the absence of JzTx-V(1-29) (SEQ ID NO:2), "0.5 μM TTX" indicates Nav current in the presence of 0.5 μM TTX to block endogenous TTX-sensitive channels, "1.0 μM TTX-R inhibitor" indicates Nav current in the presence of a blocker of Nav1.8 channels that are resistant to block by TTX, and "Wash" indicates Nav current following removal of JzTx-V(1-29) (SEQ ID NO:2) and TTX. 0.5 μM TTX was present in all solutions when cells were held at −85 mV.
Figure 6:
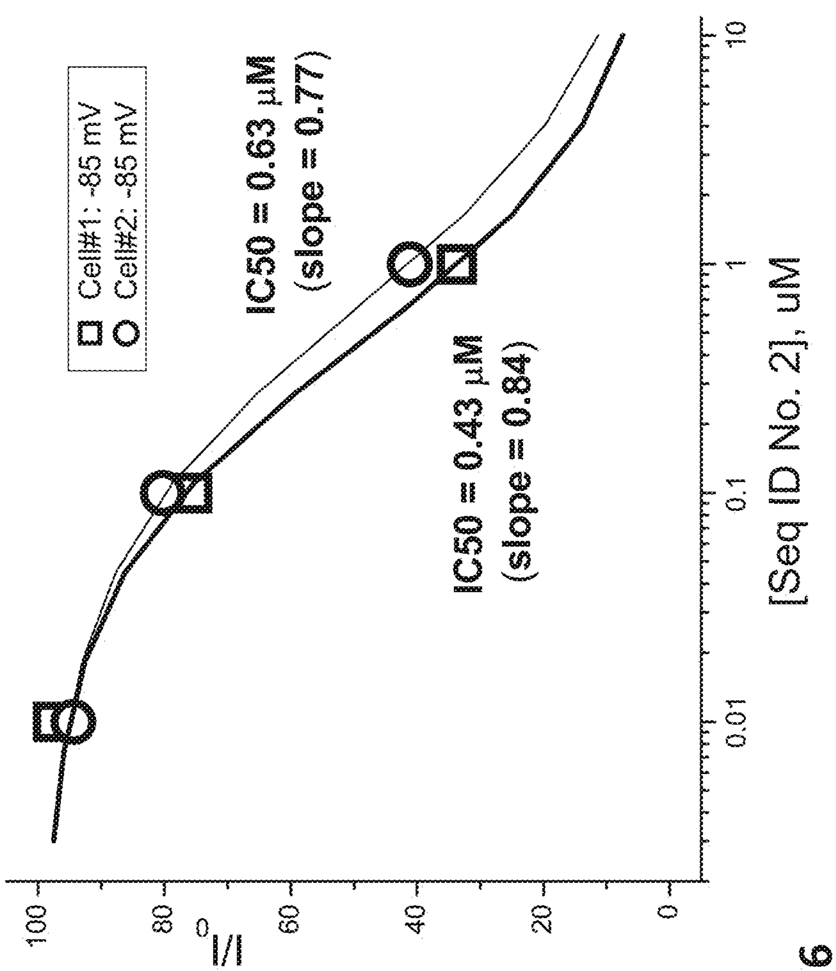
FIG. 6 shows the dose-response curves of JzTx-V(1-29) (SEQ ID NO:2) against hNav1.8 channels in two separate inducible CHO cells. Peak inward Nav currents were measured at 0 mV in the presence of increasing concentrations of JzTx-V(1-29) (SEQ ID NO:2).

Briefly, the PEG groups are generally attached to the peptide portion of the composition of the invention via acylation or reductive alkylation (or reductive amination) through a reactive group on the PEG moiety (e.g., an aldehyde, amino, thiol, or ester group) to a reactive group on the inventive compound (e.g., an aldehyde, amino, or ester group). A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis (see, for example, FIGS. 5 and 6 and the accompanying text herein). The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

PEG is a well-known, water soluble polymer that is commercially available or can be prepared by ring-opening polymerization of ethylene glycol according to methods well known in the art (Sandler and Karo, Polymer Synthesis, Academic Press, New York, Vol. 3, pages 138-161). In the present application, the term "PEG" is used broadly to encompass any polyethylene glycol molecule, in mono-, bi-, or poly-functional form, without regard to size or to modification at an end of the PEG, and can be represented by the formula:

$$X\text{-}O(CH_2CH_2O)_{n-1}CH_2CH_2OH, \quad (I)$$

where n is 20 to 2300 and X is H or a terminal modification, e.g., a $C_{1-4}$ alkyl.

In some useful embodiments, a PEG used in the invention terminates on one end with hydroxy or methoxy, i.e., X is H or $CH_3$ ("methoxy PEG"). It is noted that the other end of the PEG, which is shown in formula (I) terminating in OH, covalently attaches to an activating moiety via an ether oxygen bond, an amine linkage, or amide linkage. When used in a chemical structure, the term "PEG" includes the formula (I) above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

$$(PEG)\text{-}(A) \quad (II)$$

where PEG (defined supra) covalently attaches to a carbon atom of the activation moiety (A) to form an ether bond, an amine linkage, or amide linkage, and (A) contains a reactive group which can react with an amino, azido, alkyne, imino, maleimido, N-succinimidyl, carboxyl, aminooxy, seleno, or thiol group on an amino acid residue of a peptide or a linker moiety covalently attached to the peptide, e.g., the toxin peptide analog.

Techniques for the preparation of activated PEG and its conjugation to biologically active peptides are well known in the art. (E.g., see U.S. Pat. Nos. 5,643,575, 5,919,455, 5,932,462, and 5,990,237; Kinstler et al., N-terminally chemically modified protein compositions and methods, U.S. Pat. Nos. 5,985,265, and 5,824,784; Thompson et al., PEGylation of polypeptides, EP 0575545 B1; Petit, Site specific protein modification, U.S. Pat. Nos. 6,451,986, and 6,548,644; S. Herman et al., Poly(ethylene glycol) with reactive endgroups: I. Modification of proteins, J. Bioactive Compatible Polymers, 10:145-187 (1995); Y. Lu et al., PEGylated peptides III: Solid-phase synthesis with PEGylating reagents of varying molecular weight: synthesis of multiply PEGylated peptides, Reactive Polymers, 22:221-229 (1994); A. M. Felix et al., PEGylated Peptides IV: Enhanced biological activity of site-directed PEGylated GRF analogs, Int. J. Peptide Protein Res., 46:253-264 (1995); A. M. Felix, Site-specific poly(ethylene glycol) ylation of peptides, ACS Symposium Series 680(poly(ethylene glycol)): 218-238 (1997); Y. Ikeda et al., Polyethylene glycol derivatives, their modified peptides, methods for producing them and use of the modified peptides, EP 0473084 B1; G. E. Means et al., Selected techniques for the modification of protein side chains, in: Chemical modification of proteins, Holden Day, Inc., 219 (1971)).

Activated PEG, such as PEG-aldehydes or PEG-aldehyde hydrates, can be chemically synthesized by known means or obtained from commercial sources, e.g., Shearwater Polymers, (Huntsville, Ala.) or Enzon, Inc. (Piscataway, N.J.).

An example of a useful activated PEG for purposes of the present invention is a PEG-aldehyde compound (e.g., a methoxy PEG-aldehyde), such as PEG-propionaldehyde, which is commercially available from Shearwater Polymers (Huntsville, Ala.). PEG-propionaldehyde is represented by the formula PEG-$CH_2CH_2CHO$. (See, e.g., U.S. Pat. No. 5,252,714). Also included within the meaning of "PEG aldehyde compound" are PEG aldehyde hydrates, e.g., PEG acetaldehyde hydrate and PEG bis aldehyde hydrate, which latter yields a bifunctionally activated structure. (See., e.g., Bentley et al., Poly(ethylene glycol) aldehyde hydrates and related polymers and applications in modifying amines, U.S. Pat. No. 5,990,237) (See., e.g., Bentley et al., Poly(ethylene glycol) aldehyde hydrates and related polymers and applications in modifying amines, U.S. Pat. No. 5,990,237). An activated multi-branched PEG-aldehyde compound can be used (PEG derivatives comprising multiple arms to give divalent, trivalent, tetravalent, octavalent constructs). Using a 4-arm PEG derivative four (4) toxin peptide analogs are attached to each PEG molecule. For example, in accordance with the present invention, the toxin peptide analog can be conjugated to a polyethylene glycol (PEG) at 1, 2, 3 or 4 amino functionalized sites of the PEG.

In being conjugated in accordance with the inventive method, the polyethylene glycol (PEG), as described herein, is covalently bound by reductive amination directly to at least one solvent-exposed free amine moiety of an amino acid residue of the toxin peptide analog itself. In some embodiments of the inventive method, the toxin peptide analog is conjugated to a PEG at one or more primary or secondary amines on the toxin peptide analog, or to two PEG groups at a single primary amine site on the toxin peptide analog (e.g., this can occur when the reductive amination reaction involves the presence of excess PEG-aldehyde compound). We have observed that when PEGylation by reductive amination is at a primary amine on the peptide, it is not uncommon to have amounts (1 to 100% range) of reaction product that have two or more PEGs present per molecule, and if the desired PEGylation product is one with only one PEG per molecule, then this "over-PEGylation" may be undesirable. When PEGylated product with a single PEG per PEGylation product molecule is desired, an embodiment of the inventive method can be employed that involves PEGylation using secondary amines of the pharmacologically active peptide, because only one PEG group per molecule will be transferred in the reductive amination reaction.

Amino acid residues that can provide a primary amine moiety include residues of lysine, homolysine, ornithine, α,β-diaminopropionic acid (Dap), α,β-diaminopropionoic acid (Dpr), and α,γ-diaminobutyric acid (Dab), aminobutyric acid (Abu), and α-amino-isobutyric acid (Aib). The polypeptide N-terminus also provides a useful α-amino group for PEGylation. Amino acid residues that can provide a secondary amine moiety include ε-N-alkyl lysine, α-N-alkyl lysine, δ-N-alkyl ornithine, α-N-alkyl ornithine, or an N-terminal proline, where the alkyl is $C_1$ to $C_6$.

Another useful activated PEG for generating the PEGylated toxin peptide analogs of the present invention is a PEG-maleimide compound, such as, but not limited to, a methoxy PEG-maleimide, such as maleimido monomethoxy PEG, are particularly useful for generating the PEG-conjugated peptides of the invention. (E.g., Shen, N-maleimidyl polymer derivatives, U.S. Pat. No. 6,602,498; C. Delgado et al., The uses and properties of PEG-linked proteins., Crit. Rev. Therap. Drug Carrier Systems, 9:249-304 (1992); S. Zalipsky et al., Use of functionalized polyethylene glycol)s for modification of polypeptides, in: Poly(ethylene glycol) chemistry: Biotechnical and biomedical applications (J. M. Harris, Editor, Plenum Press: New York, 347-370 (1992); S. Herman et al., Poly(ethylene glycol) with reactive endgroups: I. Modification of proteins, J. Bioactive Compatible Polymers, 10:145-187 (1995); P. J. Shadle et al., Conjugation of polymer to colony stimulating factor-1, U.S. Pat. No. 4,847,325; G. Shaw et al., Cysteine added variants IL-3 and chemical modifications thereof, U.S. Pat. No. 5,166,322 and EP 0469074 B1; G. Shaw et al., Cysteine added variants of EPO and chemical modifications thereof, EP 0668353 A1; G. Shaw et al., Cysteine added variants G-CSF and chemical modifications thereof, EP 0668354 A1; N. V. Katre et al., Interleukin-2 muteins and polymer conjugation thereof, U.S. Pat. No. 5,206,344; R. J. Goodson and N. V. Katre, Site-directed pegylation of recombinant interleukin-2 at its glycosylation site, Biotechnology, 8:343-346 (1990)).

A polyethylene glycol) vinyl sulfone is another useful activated PEG for generating the PEG-conjugated toxin peptide analogs of the present invention by conjugation at thiolated amino acid residues, e.g., at C residues. (E.g., M. Morpurgo et al., Preparation and characterization of polyethylene glycol) vinyl sulfone, Bioconj. Chem., 7:363-368 (1996); see also Harris, Functionalization of polyethylene glycol for formation of active sulfone-terminated PEG derivatives for binding to proteins and biologically compatible materials, U.S. Pat. Nos. 5,446,090; 5,739,208; 5,900,461; 6,610,281 and 6,894,025; and Harris, Water soluble active sulfones of polyethylene glycol), WO 95/13312 A1). Another activated form of PEG that is useful in accordance with the present invention, is a PEG-N-hydroxysuccinimide ester compound, for example, methoxy PEG-N-hydroxysuccinimidyl (NHS) ester.

Heterobifunctionally activated forms of PEG are also useful. (See, e.g., Thompson et al., PEGylation reagents and biologically active compounds formed therewith, U.S. Pat. No. 6,552,170).

In still other embodiments of the inventive method of producing a composition of matter, the toxin peptide analog is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, Polyethylene glycol) with Reactive Endgroups: I. Modification of Proteins, J. Bioactive and Compatible Polymers, 10:145-187 (1995); S. Zalipsky, Chemistry of Polyethylene Glycol Conjugates with Biologically Active Molecules, Advanced Drug Delivery Reviews, 16:157-182 (1995); R. Greenwald et al., Polyethylene glycol) conjugated drugs and prodrugs: a comprehensive review, Critical Reviews in Therapeutic Drug Carrier Systems, 17:101-161 (2000)).

An even more preferred activated PEG for generating the PEG-conjugated toxin peptide analogs of the present invention is a multivalent PEG having more than one activated residues. Preferred multivalent PEG moieties include, but are not limited to, those shown below:

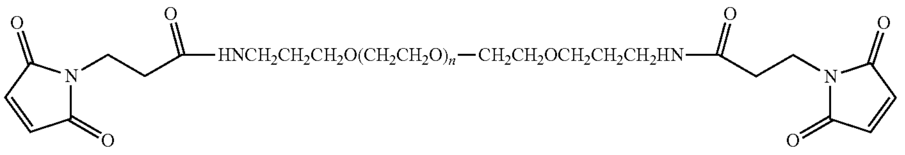

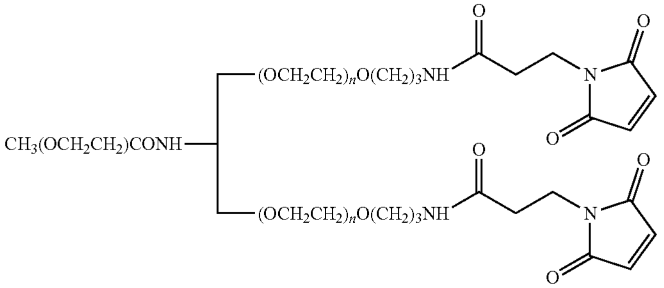

-continued

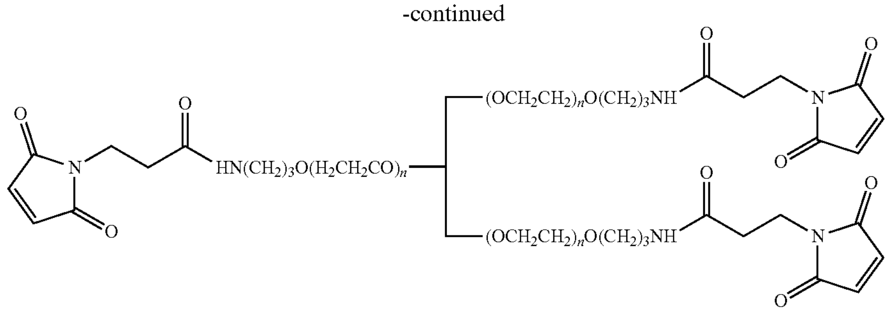

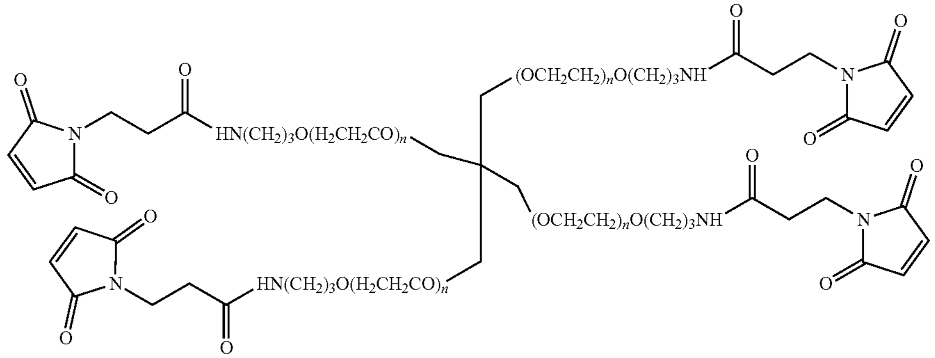

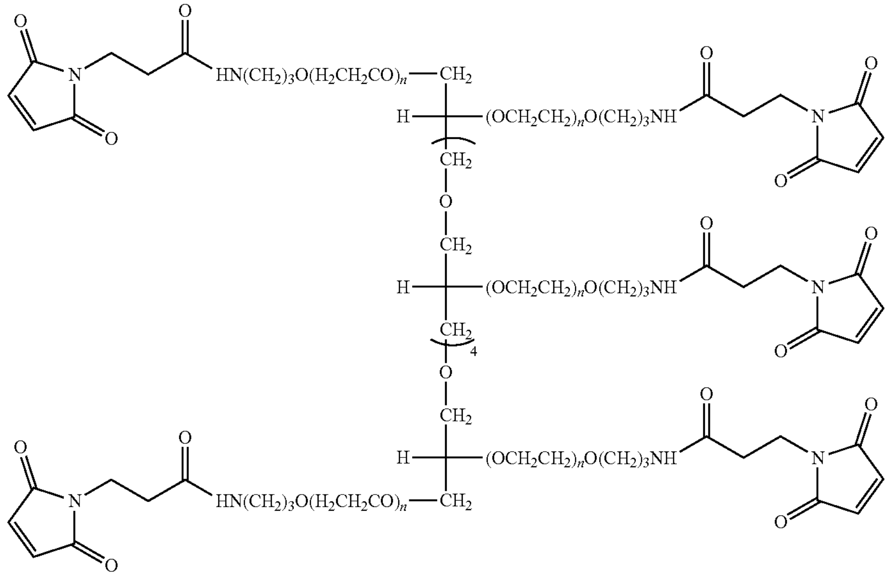

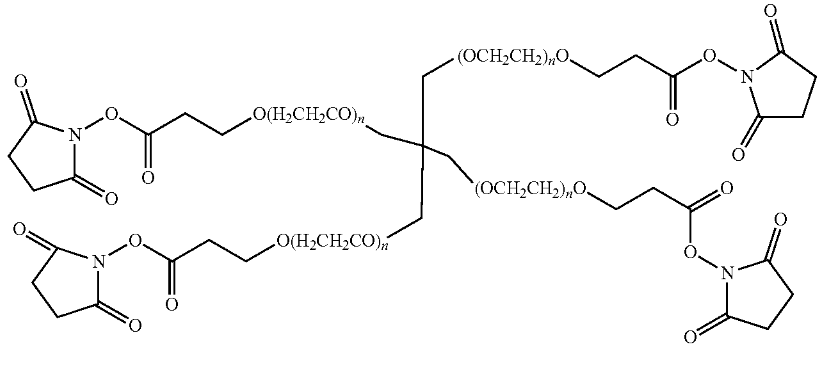

In still other embodiments of making the composition of matter, the inventive toxin peptide analog is reacted by known chemical techniques with an activated multi-branched PEG compound (PEG derivatives comprising multiple arms to give divalent, trivalent, tetravalent, octavalent constructs), such as but not limited to, pentaerythritol tetra-polyethyleneglycol ether. Functionalization and activated derivatives, such as, but not limited to, N-succinimidyloxy-carbonyl)propyl, p-nitrophenyloxycarbonyl, (—$CO_2$-p-$C_6H_4NO_2$), 3-(N-maleimido)propanamido, 2-sulfanylethyl, and 3-aminopropyl. Using a 4-arm PEG derivative, four toxin peptide analogs are attached to each PEG molecule. For example, in accordance with the present invention, the toxin peptide analog can be conjugated to a polyethylene glycol (PEG) at:

(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

The smallest practical size of PEG is about 500 Daltons (Da), below which PEG becomes toxic. Above about 500 Da, any molecular mass for a PEG can be used as practically desired, e.g., from about 1,000 Daltons (Da) to 100,000 Da (n is 20 to 2300). The number of PEG monomers (n) is approximated from the average molecular mass using a MW=44 Da for each monomer. It is preferred that the combined molecular mass of PEG on an activated linker is suitable for pharmaceutical use. Thus, the combined molecular mass of the PEG molecule should not exceed about 100,000 Da. In some embodiments, the combined or total average molecular mass of PEG used in a PEG-conjugated toxin peptide analog of the present invention is from about 3,000 Da to 60,000 Da (total n is from 70 to 1,400), more preferably from about 10,000 Da to 40,000 Da (total n is about 230 to about 910). The most preferred combined mass for PEG is from about 20,000 Da to 30,000 Da (total n is about 450 to about 680).

It will be appreciated that "multimers" of the composition of matter can be made, since the half-life extending moiety employed for conjugation to the toxin peptide analog (with or without an intervening linker moiety) can be multivalent (e.g., bivalent, trivalent, tetravalent or a higher order valency) as to the number of amino acid residues at which the half-life extending moiety can be conjugated. In some embodiments the peptide portion of the inventive composition of matter can be multivalent (e.g., bivalent, trivalent, tetravalent or a higher order valency), and, thus, some "multimers" of the inventive composition of matter may have more that one half life extending moiety. Consequently, it is possible by the inventive method of producing a composition of matter to produce a variety of conjugated half-life extending moiety peptide structures. By way of example, a univalent half-life extending moiety and a univalent peptide will produce a 1:1 conjugate; a bivalent peptide and a univalent half-life extending moiety may form conjugates wherein the peptide conjugates bear two half-life extending moiety moieties, whereas a bivalent half-life extending moiety and a univalent peptide may produce species where two peptide entities are linked to a single half-life extending moiety; use of higher-valence half-life extending moiety can lead to the formation of clusters of peptide entities bound to a single half-life extending moiety, whereas higher-valence peptides may become encrusted with a plurality of half-life extending moiety moieties. By way of further example, if the site of conjugation of a multivalent half-life extending moiety to the toxin peptide analog is a cysteine or other aminothiol the methods disclosed by D'Amico et al. may be employed (D'Amico et al., Method of conjugating aminothiol containing molecules to vehicles, published as US 2006/0199812, which application is incorporated herein by reference in its entirety).

The peptide moieties may have more than one reactive group which will react with the activated half-life extending moiety and the possibility of forming complex structures must always be considered; when it is desired to form simple structures such as 1:1 adducts of half-life extending moiety and peptide, or to use bivalent half-life extending moiety to form peptide:half-life extending moiety:peptide adducts, it will be beneficial to use predetermined ratios of activated half-life extending moiety and peptide material, predetermined concentrations thereof and to conduct the reaction under predetermined conditions (such as duration, temperature, pH, etc.) so as to form a proportion of the described product and then to separate the described product from the other reaction products. The reaction conditions, proportions and concentrations of the reagents can be obtained by relatively simple trial-and-error experiments which are within the ability of an ordinarily skilled artisan with appropriate scaling-up as necessary. Purification and separation of the products is similarly achieved by conventional techniques well known to those skilled in the art.

Additionally, physiologically acceptable salts of the half-life extending moiety-fused or conjugated to the toxin peptide analogs of this invention are also encompassed within the composition of matter of the present invention.

The above-described half-life extending moieties and other half-life extending moieties described herein are useful, either individually or in combination, and as further described in the art, for example, in Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties. The invention encompasses the use of any single species of pharmaceutically acceptable half-life extending moiety, such as, but not limited to, those described herein, in conjugation with the toxin peptide analog, or the use of a combination of two or more like or different half-life extending moieties.

Linkers

A "linker moiety" as used herein refers to a biologically acceptable peptidyl or non-peptidyl organic group that is covalently bound to an amino acid residue of a toxin peptide analog or other polypeptide chain (e.g., an immunoglobulin HC or LC or immunoglobulin Fc domain) contained in the inventive composition, which linker moiety covalently joins or conjugates the toxin peptide analog or other polypeptide chain to another peptide or polypeptide chain in the composition, or to a half-life extending moiety. In some embodiments of the composition, a half-life extending moiety, as described herein, is conjugated, i.e., covalently bound directly to an amino acid residue of the toxin peptide analog itself, or optionally, to a peptidyl or non-peptidyl linker moiety (including but not limited to aromatic or aryl linkers) that is covalently bound to an amino acid residue of the toxin peptide analog. The presence of any linker moiety is optional. When present, its chemical structure is not critical, since it serves primarily as a spacer to position, join, connect, or optimize presentation or position of one functional moiety in relation to one or more other functional moieties of a molecule of the inventive composition. The presence of a linker moiety can be useful in optimizing pharamcologial activity of some embodiments of the inventive composition. The linker, if present, can be made up of amino acids linked together by peptide bonds. The linker moiety, if present, can be independently the same or different from any other linker, or linkers, that may be present in the inventive composition. In some embodiments the linker can be a multivalent linker that facilitates multivalent display of toxin peptide analogs of the present invention; multivalent display of such biologically active compounds can increase binding affinity and/or potency through avidity. The in vivo properties of a therapeutic can be altered (i.e., specific targeting, half-life extension, distribution profile, etc.) through conjugation to a polymer or protein.

Peptidyl Linkers.

As stated above, the linker moiety, if present (whether within the primary amino acid sequence of the toxin peptide analog, or as a linker for attaching a half-life extending moiety to the toxin peptide analog), can be "peptidyl" in nature (i.e., made up of amino acids linked together by peptide bonds) and made up in length, preferably, of from 1 up to about 40 amino acid residues, more preferably, of from 1 up to about 20 amino acid residues, and most preferably of from 1 to about 10 amino acid residues. Preferably, but not necessarily, the amino acid residues in the linker are from among the twenty canonical amino acids, more preferably, cysteine, glycine, alanine, proline, asparagine, glutamine, and/or serine. Even more preferably, a peptidyl linker is made up of a majority of amino acids that are sterically unhindered, such as glycine, serine, and alanine linked by a peptide bond. It is also desirable that, if present, a peptidyl linker be selected that avoids rapid proteolytic turnover in circulation in vivo. Some of these amino acids may be glycosylated, as is well understood by those in the art. For example, a useful linker sequence constituting a sialylation site is $X_1X_2NX_4X_5G$ (SEQ ID NO:479), wherein $X_1$, $X_2$, $X_4$ and $X_5$ are each independently any amino acid residue.

In other embodiments, the 1 to 40 amino acids of the peptidyl linker moiety are selected from glycine, alanine, proline, asparagine, glutamine, and lysine. Preferably, a linker is made up of a majority of amino acids that are sterically unhindered, such as glycine and alanine. Thus, preferred linkers include polyglycines, polyserines, and polyalanines, or combinations of any of these. Some exemplary peptidyl linkers are poly$(Gly)_{1-8}$, particularly $(Gly)_3$, $(Gly)_4$ (SEQ ID NO:480), $(Gly)_5$ (SEQ ID NO:481) and (Gly) (SEQ ID NO:482), as well as, GlySer and poly$(Gly)_4$Ser, such as "L15" (GGGGSGGGGSGGGGS; SEQ ID NO:483), poly$(Gly\text{-}Ala)_{2-4}$ and poly$(Ala)_{1-8}$. Other specific examples of peptidyl linkers include $(Gly)_5$Lys (SEQ ID NO:484), and $(Gly)_5$LysArg (SEQ ID NO:485). Other examples of useful peptidyl linkers are: Other examples of useful peptidyl linkers are:

(SEQ ID NO: 486)
$(Gly)_3Lys(Gly)_4$;

(SEQ ID NO: 487)
$(Gly)_3AsnGlySer(Gly)_2$;

(SEQ ID NO: 488)
$(Gly)_3Cys(Gly)_4$;
and (SEQ ID NO: 489)
GlyProAsnGlyGly.

To explain the above nomenclature, for example, $(Gly)_3Lys(Gly)_4$ means Gly-Gly-Gly-Lys-Gly-Gly-Gly-Gly (SEQ ID NO:490). Other combinations of Gly and Ala are also useful.

Other preferred linkers are those identified herein as "L5" (GGGGS; or "$G_4S$"; SEQ ID NO:491), "L10" (GGGGSGGGGS; SEQ ID NO:492); "L20" (GGGGSGGGGSGGGGSGGGGS; SEQ ID NO:477); "L25" (GGGGSGGGGSGGGGSGGGGSGGGGS; SEQ ID NO:493) and any linkers used in the working examples hereinafter.

In some embodiments of the compositions of this invention, which comprise a peptide linker moiety, acidic residues, for example, glutamate or aspartate residues, are placed in the amino acid sequence of the linker moiety. Examples include the following peptide linker sequences:

(SEQ ID NO: 494)
GGEGGG;

(SEQ ID NO: 495)
GGEEEGGG;

(SEQ ID NO: 496)
GEEEG;

(SEQ ID NO: 497)
GEEE;

(SEQ ID NO: 498)
GGDGGG;

(SEQ ID NO: 499)
GGDDDGG;

(SEQ ID NO: 500)
GDDDG;

(SEQ ID NO: 501)
GDDD;

(SEQ ID NO: 502)
GGGGSDDSDEGSDGEDGGGGS;

(SEQ ID NO: 503)
WEWEW;

(SEQ ID NO: 504)
FEFEF;

(SEQ ID NO: 505)
EEEWWW;

(SEQ ID NO: 506)
EEEFFF;

(SEQ ID NO: 507)
WWEEEWW;
or (SEQ ID NO: 508)
FFEEEFF.

In other embodiments, the linker constitutes a phosphorylation site, e.g., $X_1X_2YX_4X_5G$ (SEQ ID NO:509), wherein $X_1$, $X_2$, $X_4$, and $X_5$ are each independently any amino acid residue; $X_1X_2SX_4X_5G$ (SEQ ID NO:510), wherein $X_1$, $X_2$, $X_4$ and $X_5$ are each independently any amino acid residue; or $X_1X_2TX_4X_5G$ (SEQ ID NO:511), wherein $X_1$, $X_2$, $X_4$ and $X_5$ are each independently any amino acid residue.

The linkers shown here are exemplary; peptidyl linkers within the scope of this invention may be much longer and may include other residues. A peptidyl linker can contain, e.g., a cysteine, another thiol, or nucleophile for conjugation with a half-life extending moiety. In another embodiment, the linker contains a cysteine or homocysteine residue, or other 2-amino-ethanethiol or 3-amino-propanethiol moiety for conjugation to maleimide, iodoacetaamide or thioester, functionalized half-life extending moiety.

Another useful peptidyl linker is a large, flexible linker comprising a random Gly/Ser/Thr sequence, for example: GSGSATGGSGSTASSGSGSATH (SEQ ID NO:512) or HGSGSATGGSGSTASSGSGSAT (SEQ ID NO:513), that is estimated to be about the size of a 1 kDa PEG molecule. Alternatively, a useful peptidyl linker may be comprised of amino acid sequences known in the art to form rigid helical structures (e.g., Rigid linker: -AEAAAKEAAAKEAAAK-AGG-//SEQ ID NO:514). Additionally, a peptidyl linker can also comprise a non-peptidyl segment such as a 6 carbon aliphatic molecule of the formula $—CH_2—CH_2—CH_2—CH_2—CH_2—CH_2—$. The peptidyl linkers can be altered to form derivatives as described herein.

Non-Peptidyl Linkers.

Optionally, a non-peptidyl linker moiety is also useful for conjugating the half-life extending moiety to the peptide portion of the half-life extending moiety-conjugated toxin peptide analog. For example, alkyl linkers such as $—NH—(CH_2)_s—C(O)—$, wherein s=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc. Exemplary non-peptidyl linkers are PEG linkers (e.g., shown below):

(III)

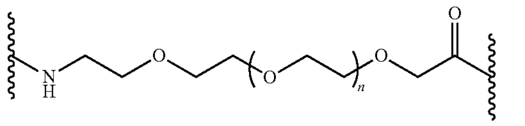

wherein n is such that the linker has a molecular weight of about 100 to about 5000 Daltons (Da), preferably about 100 to about 500 Da.

In one embodiment, the non-peptidyl linker is aryl. The linkers may be altered to form derivatives in the same manner as described herein. In addition, PEG moieties may be attached to the N-terminal amine or selected side chain amines by either reductive alkylation using PEG aldehydes or acylation using hydroxysuccinimido or carbonate esters of PEG, or by thiol conjugation.

"Aryl" is phenyl or phenyl vicinally-fused with a saturated, partially-saturated, or unsaturated 3-, 4-, or 5 membered carbon bridge, the phenyl or bridge being substituted by 0, 1, 2 or 3 substituents selected from $C_{1-8}$ alkyl, $C_{1-4}$ haloalkyl or halo. "Heteroaryl" is an unsaturated 5, 6 or 7 membered monocyclic or partially-saturated or unsaturated 6-, 7-, 8-, 9-, 10- or 11 membered bicyclic ring, wherein at least one ring is unsaturated, the monocyclic and the bicyclic rings containing 1, 2, 3 or 4 atoms selected from N, O and S, wherein the ring is substituted by 0, 1, 2 or 3 substituents selected from $C_{1-8}$ alkyl, $C_{1-4}$ haloalkyl and halo.

Non-peptide portions of the inventive composition of matter, such as non-peptidyl linkers or non-peptide half-life extending moieties can be synthesized by conventional organic chemistry reactions.

Multivalent Linkers.

The linker size/length, flexibility, stoichiometry, stability, etc. can have a tremendous impact on the overall activity profile of the conjugate. We have designed and prepared a series of multivalent bifunctional linkers of varied lengths that can be loaded with multiple copies of a molecule of therapeutic interest and then site specifically conjugated to a protein of interest. The utility of these linker molecules has been demonstrated in improving the potency of Nav1.7 inhibitory peptide conjugates, e.g., with Fc domain and IgG conjugates, but they are useful in the development of other peptide-large molecule, small molecule-large molecule, or peptide-small molecule conjugates.

Figure 77:
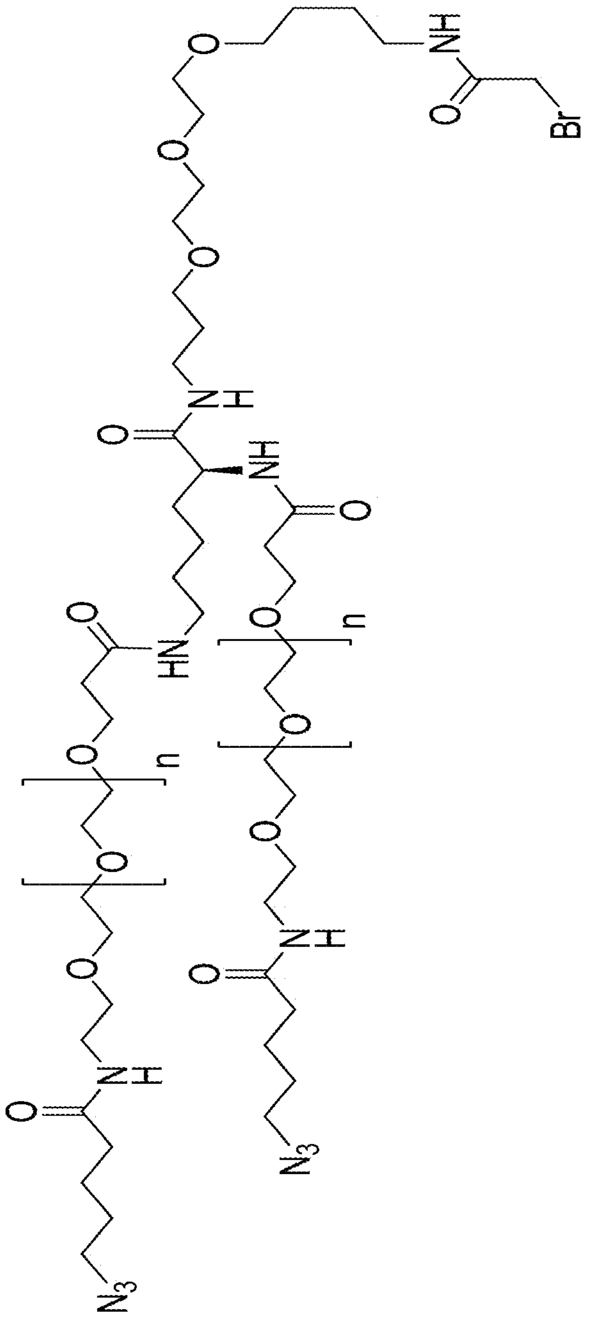
FIG. 77 shows the structure of a divalent, bifunctional linker design of the present invention.
Figure 78A:
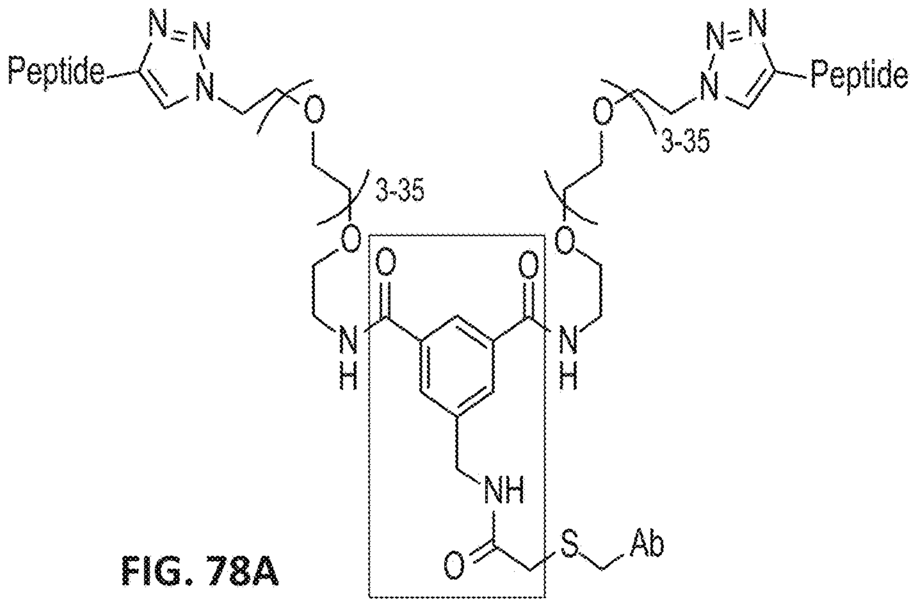
FIG. 78A-B shows structures of a divalent, bifunctional linker designs of the present invention.
Figure 78B:
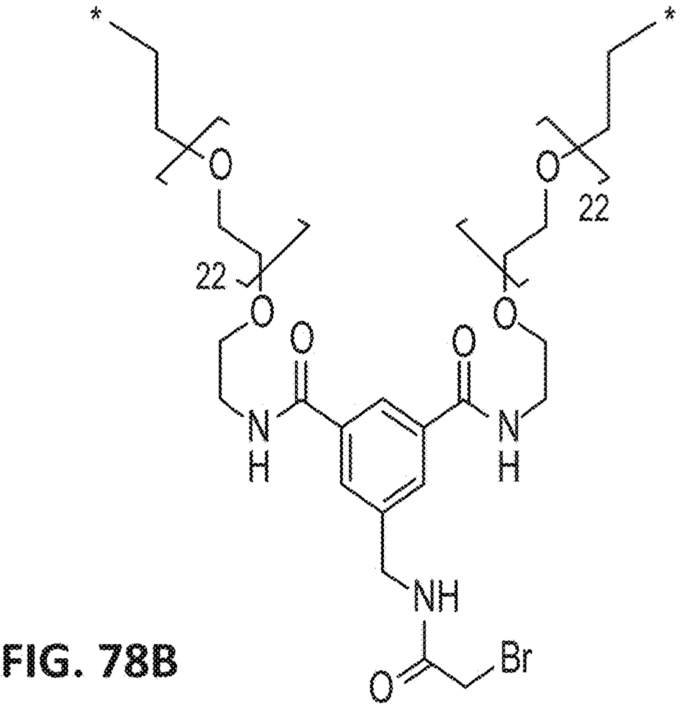
Figure 79A:
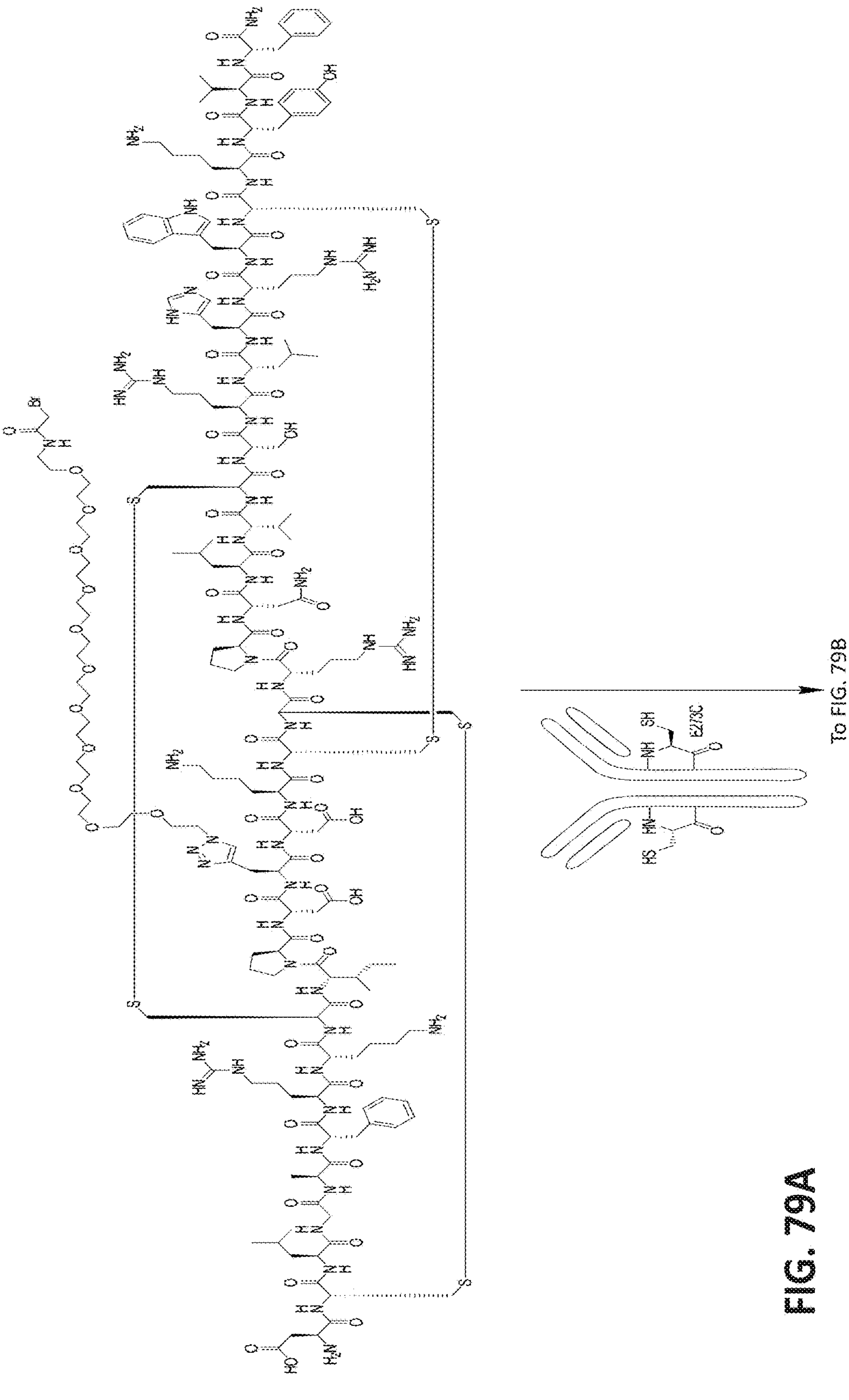
FIG. 79A-B shows a schematic conjugation of a peptidyl-linker with bromoacetamide to an engineered cysteine within a carrier protein, e.g., an immunoglobulin (IgG) protein.
Figure 79B:
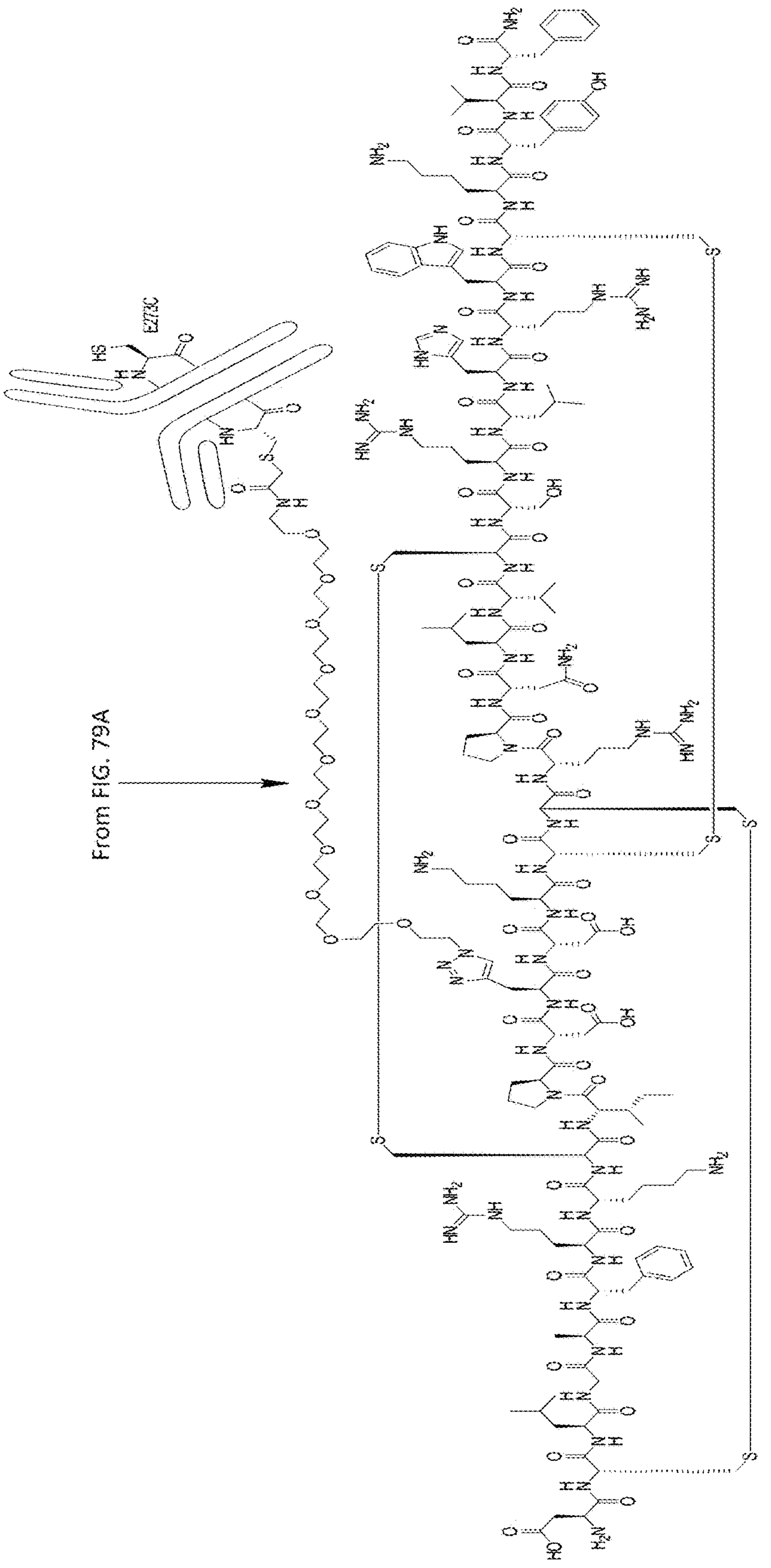
Figure 80A:
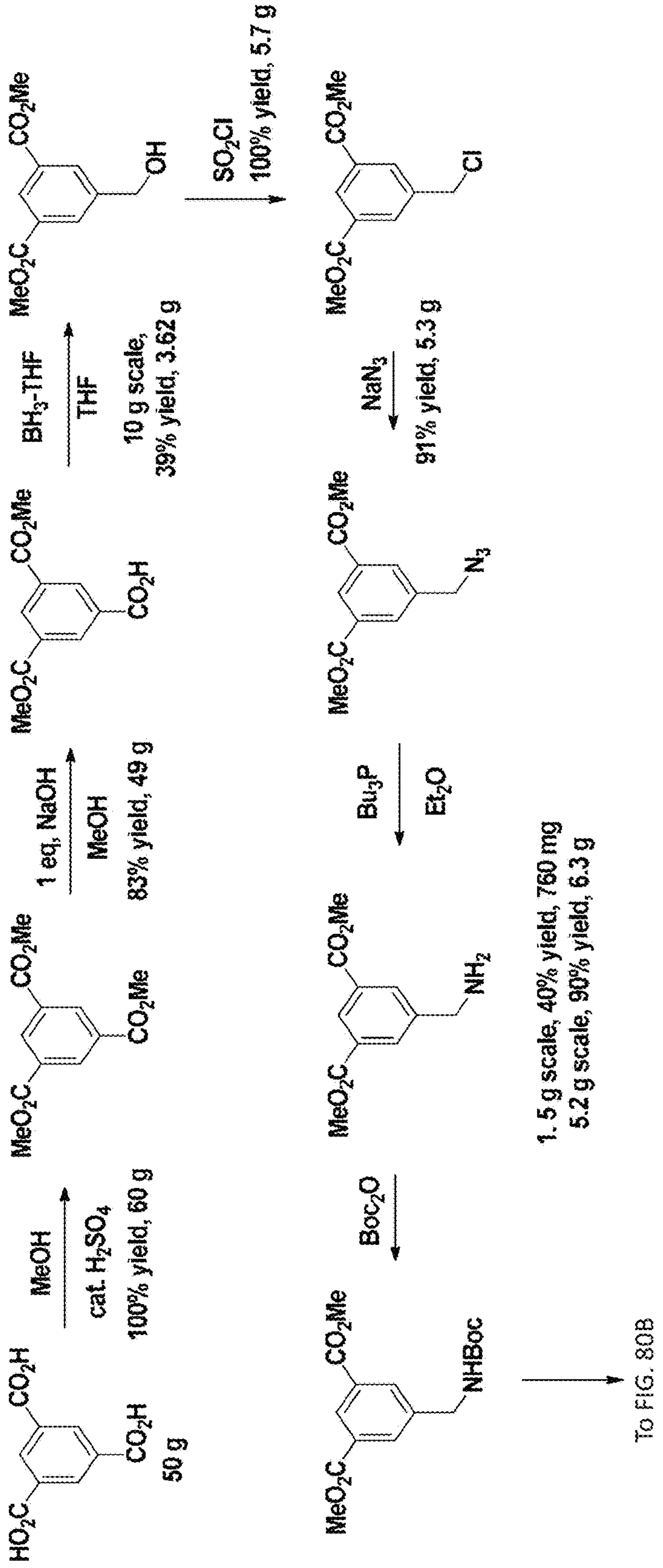
FIG. 80A-B shows a reaction scheme for preparation of multivalent linkers.
Figure 80B:
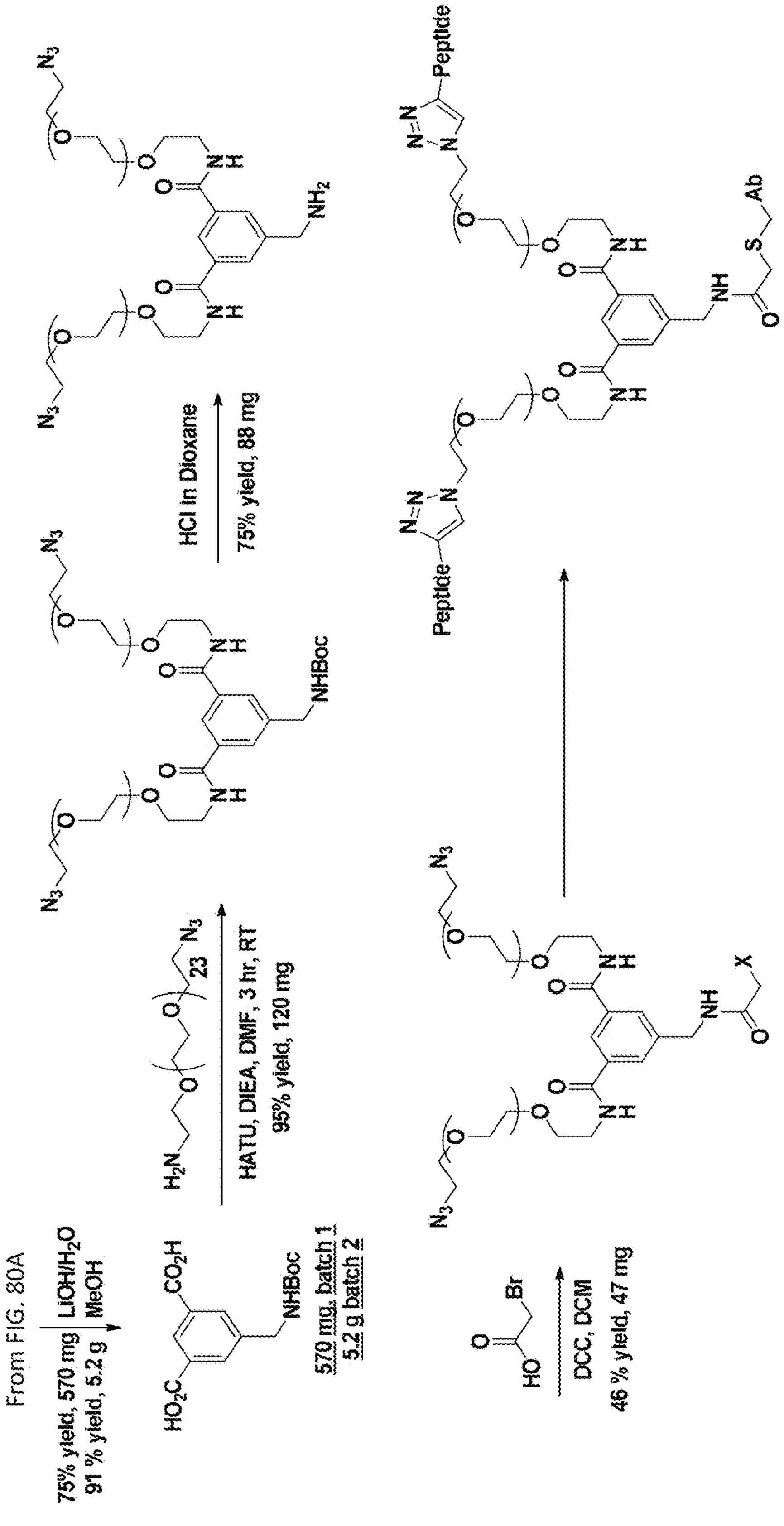

The multivalent linkers described herein are peptidyl or peptido-mimetic in nature and serve to control the distance between the inhibitor and LM, as well as the geometric relationship between the two by virtue of the conformation of the linker (i.e. extended, partially extended, helical, beta-hairpin, rigid, or flexible). The linkers are chemically differentiated on either end to accommodate orthogonal coupling chemistries (i.e. azide "Click", amide coupling, thioether formation by alkylation with maleimide or haloacetamide, oxime formation, reductive amination, etc.). Generic examples of linkers are shown in FIG. 77 and FIG. 78A-B.

Other peptides with well-defined secondary structure may provide the necessary rigidity to limit unfavorable interactions between the Nav1.7 inhibitory toxin peptide analog and the remainder of the construct. A general structure (KXXXD//SEQ ID NO:515, where K is linked to D through the amino acid side-chains) for cyclic alpha-helical peptides from Harrison, et. al. Proc. Natl. Acad. Sci. 2010, 107, 11686 may be modified to give desirable properties. X=alanine is the starting point of this reference, but X may be any amino acid for the purposes of the present invention. Additionally, the individual 5 amino-acid subunits may be spaced with other amino acids to affect properties of the overall molecule. (KXXXD)n(X)y where K and D have been cyclized. (See FIG. 84A-E).

Some additional embodiments involve using a beta-hairpin peptide as a rigid linker between the toxin peptide analog and half life extending moiety. (See, e.g., Russel, et. al. J. Am. Chem. Soc. 2003, 125:388 and Ciani, et. al. J. Am. Chem. Soc. 2003, 125:9038). Modifications can be made at either end of the peptide and the asparagine residue in the middle of each sequence. (See, FIG. 85). Each of the above linkers can be modified with suitable functional groups to allow conjugation to both the toxin peptide analog and the (protein) half life extending moiety. This can be through a bromoacetamide on one portion of the molecule and an azide on another portion of the molecule, but other suitable functionalities can also be used. The multivalent linkers can be covalently linked to the toxin peptide analog and half life extending moiety through either their C or N termini or via any of the side-chains of the peptide sequence.

Figure 86B:
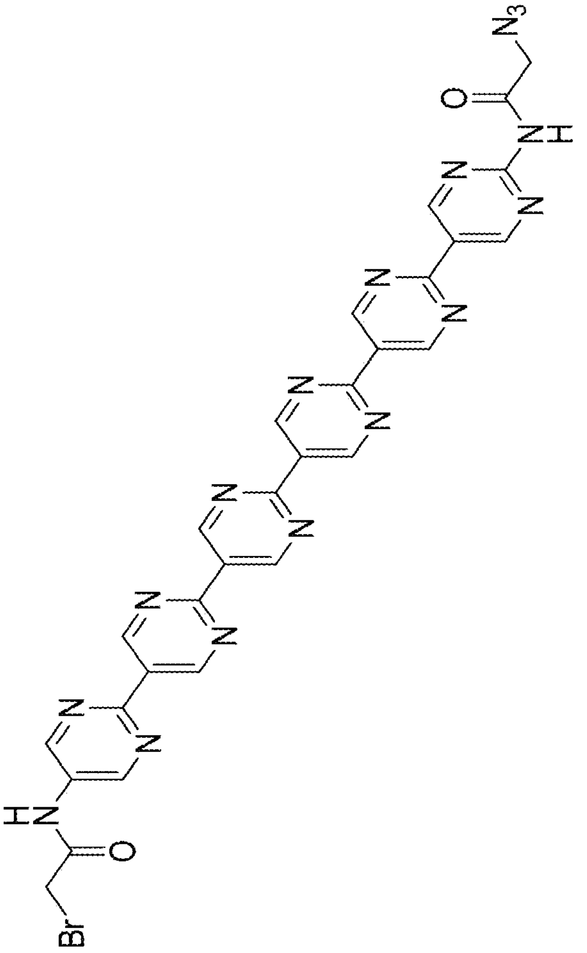
FIG. 86A-B shows exemplary generic (FIG. 86A) and representative (FIG. 86B) chemical structures of polyheterocyclic linkers for use in large-molecule-small-molecule conjugations.
Figure 86A:
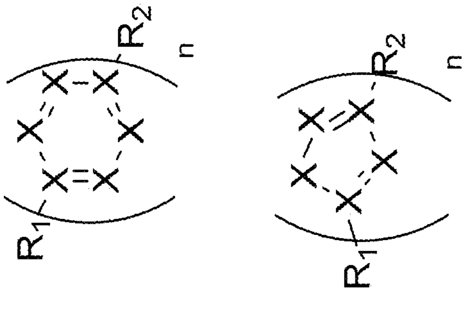
Figure 87A:
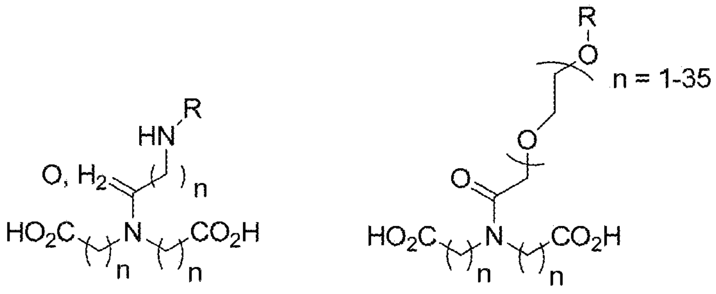
FIG. 87A-B shows exemplary generic (FIG. 87A) and representative (FIG. 87B) chemical structures of multivalent linkers for use in conjugations.
Figure 87B:
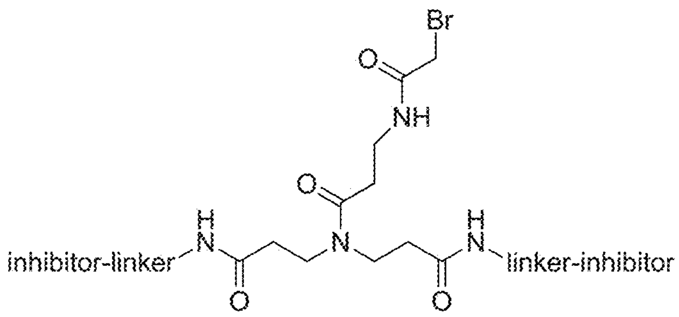
Figure 88:
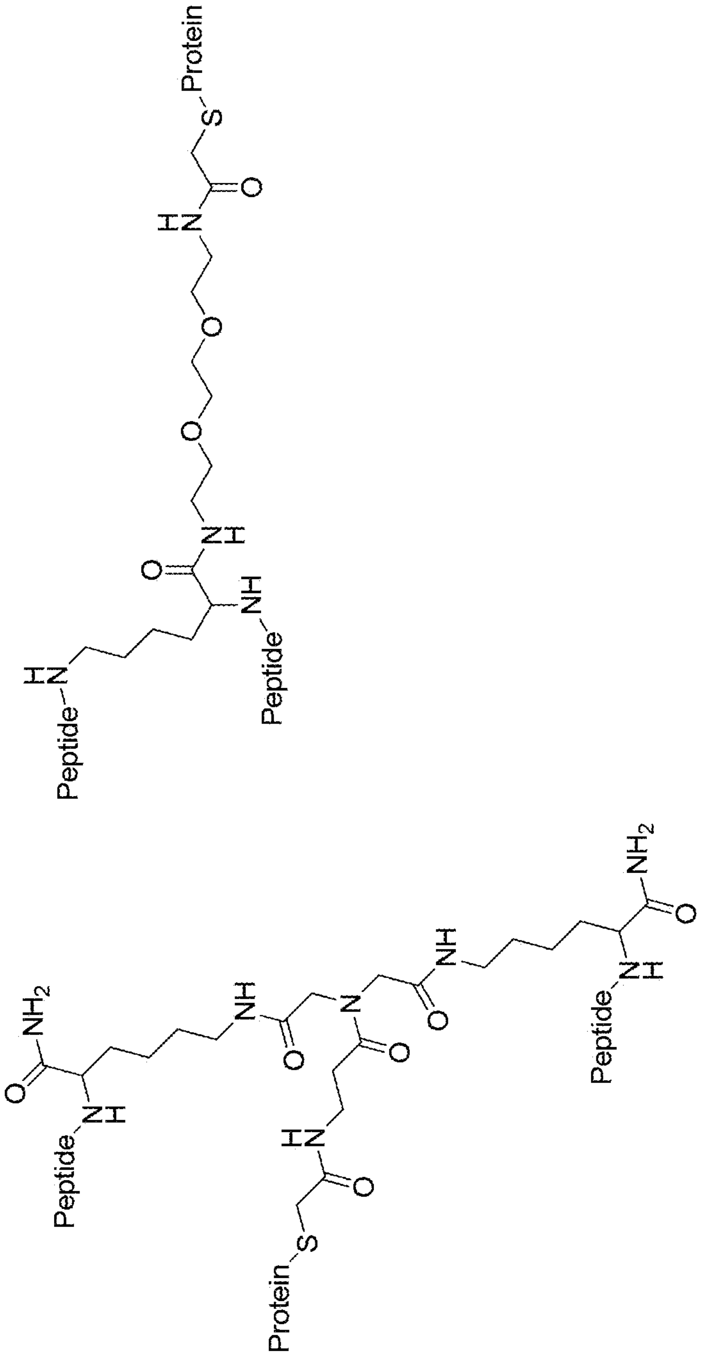
FIG. 88 shows further examples of multivalent linkers.
Figure 89B:
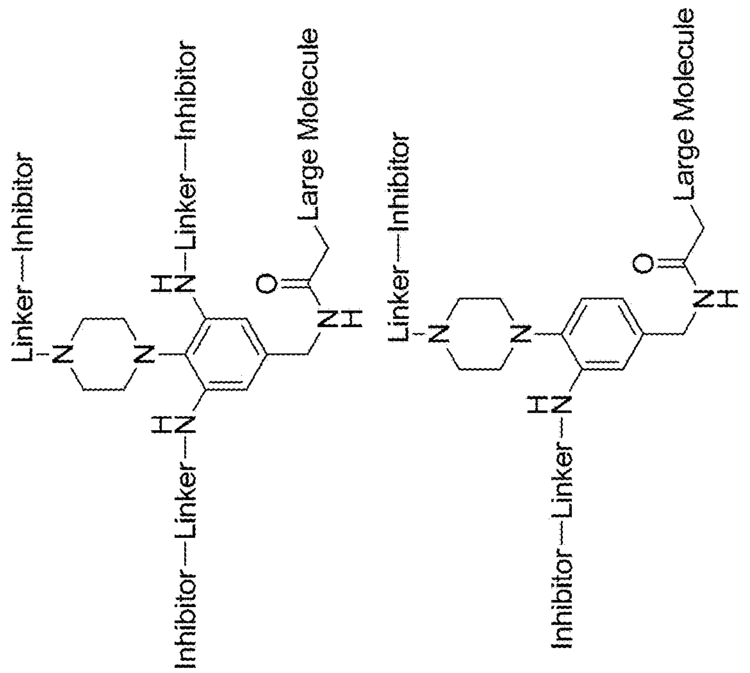
FIG. 89A-B shows exemplary generic (FIG. 89A) and representative (FIG. 89B) chemical structures of further examples of multivalent linkers for use in conjugations.
Figure 89A:
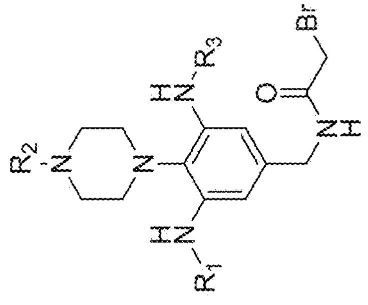
Figure 90:
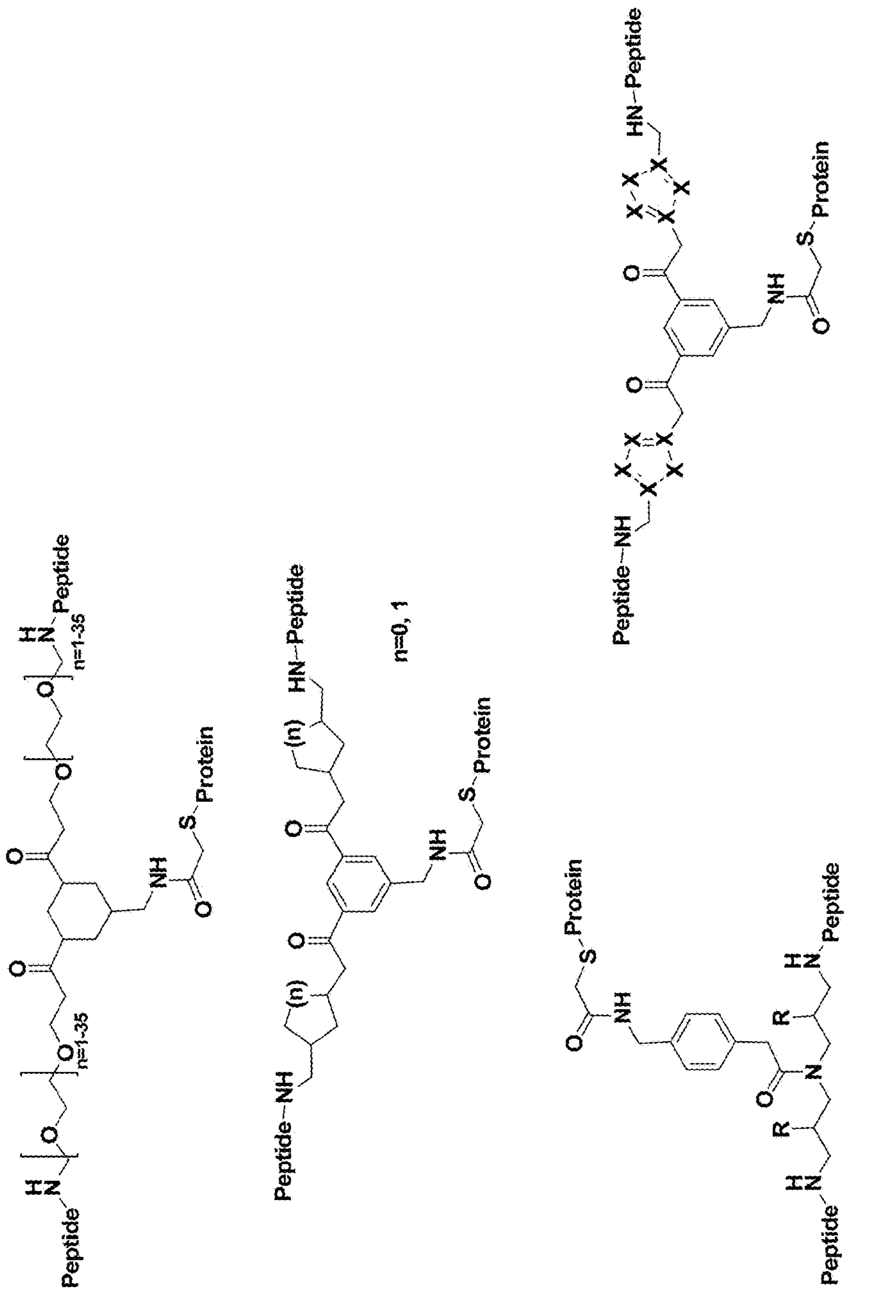
FIG. 90 shows further examples of chemical structures of multivalent linkers.
Figure 91:
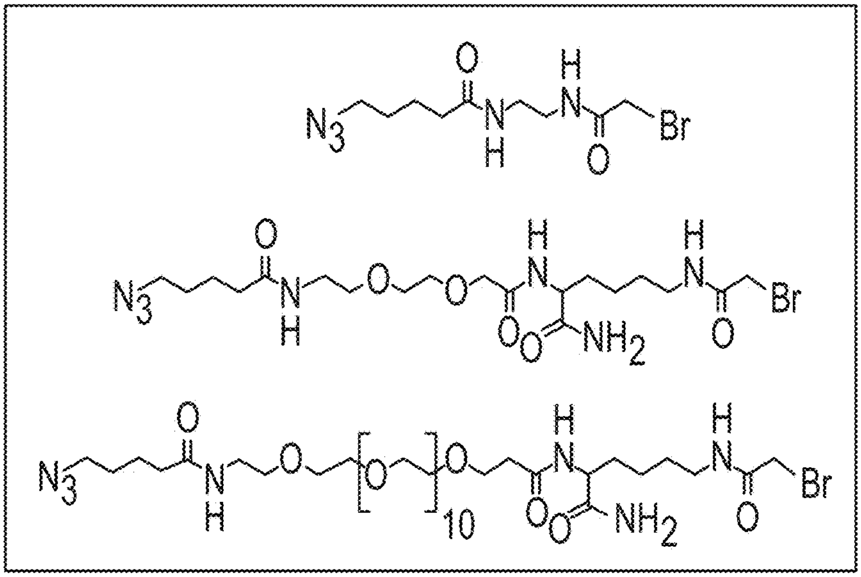
FIG. 91 shows monovalent linkers of different lengths with mixed alkyl and PEG composition and PEG-only linkers of three different lengths.
Figure 91:
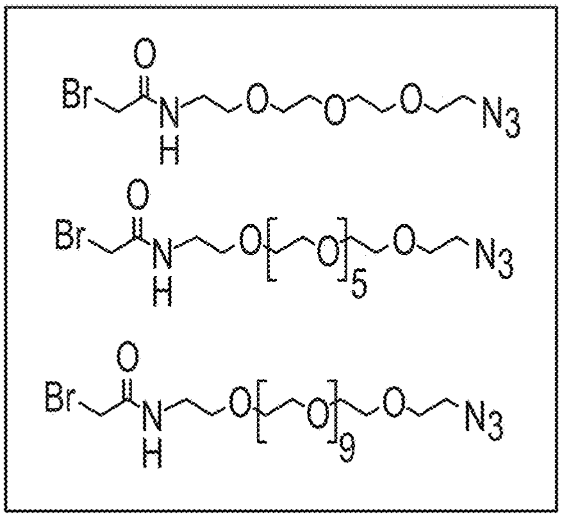

Other embodiments of the multivalent linker comprise a rigid polyheterocyclic core of controlled length. The linkers are chemically differentiated on either end to accommodate orthogonal coupling chemistries (i.e. azide "Click", amide coupling, thioether formation by alkylation with maleimide or haloacetamide, oxime formation, reductive amination, etc.). (See, FIG. 86A-B).

Still other embodiments of the multivalent linkers described herein are comprised of a multivalent core to which two or more toxin peptide analogs can be covalently linked directly, or indirectly through PEG or peptidyl or peptido-mimetic linkers, such as those described above, to a half life extending moiety. These linkers are chemically differentiated on either end to accommodate orthogonal coupling chemistries (i.e. azide "Click", amide coupling, thioether formation by alkylation with maleimide or haloacetamide, oxime formation, reductive amination, etc.). (See, e.g., FIGS. 87A-B, FIG. 88, FIGS. 89A-B, and FIG. 90).

Additional embodiments of the multivalent linkers are described in Example 10 herein.

The above is merely illustrative and not an exhaustive treatment of the kinds of linkers that can optionally be employed in accordance with the present invention.

Compositions of this invention incorporating the isolated polypeptide antagonists of the voltage-gated sodium channel $Na_V1.3$ and/or $Na_V1.7$, in particular JzTx-V toxin peptide analogs of the present invention, whether or not conjugated to a half-life extending moiety, are useful as therapeutic agents in the treatment of pain, for example in humans. Clinical genetic information, replicated independently by several groups, shows unambiguously that the product of the Nav1.7 (SCN9A) gene is a key control point for the perception of pain. In humans, loss-of-function truncation mutations of the gene lead to complete insensitivity to all forms of pain measured, whereas the human chronic pain syndromes primary erythromelalgia and paroxysmal extreme pain disorder are caused by gain-of-function mutations in $Na_V1.7$ that lead to easier or more prolonged Nav1.7 channel opening. Remarkably, no other major neurological abnormalities are present in patients carrying either truncation or gain-of-function mutations in $Na_V1.7$ (Goldberg et al., Clin Genet 71:311-319 (2007); Cox et al., Nature 444: 894-898 (2006); Ahmad et al., Hum Mol Genet 16:2114-2121 (2007); Fertleman et al., Neurology 69:586-595 (2007)). Accordingly, a therapeutic that blocks $Na_V1.7$ can be expected to be of great utility for the treatment of pain in humans.

Specific clinical chronic pain syndromes include, but are not limited to, pain associated with, or due to, cancer, chemotherapy, osteoarthritis, fibromyalgia, primary erythromelalgia, post-herpetic neuralgia, painful diabetic neuropathy, idiopathic painful neuropathy, neuromas, paroxysmal extreme pain disorder, migraine, trigeminal neuralgia, orofacial pain, cluster or other headaches, complex regional pain syndrome (CRPS), failed back surgery syndrome, sciatica (including lower back pain), interstitial cystitis and pelvic pain, inflammation-induced pain including cellulitis, and rheumatic or joint pain. A $Na_V1.7$ inhibitor can also have great utility for treatment of acute or persistent pain, including but not limited to pain following trauma, burns, or surgery. Notably, inhibition of $Na_V1.7$ is not expected to result in the adverse effects on cognition and on the gastrointestinal system that limit the use of opioid drugs. Again unlike opioids, $Na_V1.7$ inhibitors should not produce respiratory depression, patient tolerance, or addiction. Moreover, $Na_V1.7$ expression in humans and in non-human primates is overwhelmingly in the peripheral nervous system, with little or no message or protein in the brain or spinal cord (Ahmad et al., Hum Mol Genet 16:2114-2121, 2007). Consistent with these studies, our data show that among CNS areas from post-mortem humans examined with in situ hybridization, message RNA for $Na_V1.7$ was found only in light amounts in hypothalamic nuclei and in ventral motor areas of the spinal cord and spinal ependyma, areas with no known involvement in the pain response. By contrast, no $Na_V1.7$ was found in cerebral cortex, cerebellum, adrenal medulla, pituitary, or dorsal or deep regions of lumbar spinal cord. Strong $Na_V1.7$ expression was found in peripheral nerves including dorsal root ganglia, trigeminal ganglia, and myenteric plexes of the stomach and intestine. (See, Murray et al., Potent and selective inhibitors of Nav1.3 and Nav1.7, WO 2012/125973 A2, at FIGS. 13A-F therein). This suggests that an inhibitor of $Na_V1.7$ would exert analgesic efficacy via the peripheral nervous system without a need for CNS penetrance. As peptides generally do not cross the blood-brain barrier, a peptide inhibitor thus has an advantage over small molecules with some CNS-penetrance in that a peptide should not produce common off-target side effects mediated by the brain such as dizziness, confusion, or sedation.

Accordingly, the present invention also relates to the use of one or more of the inventive compositions of matter in the manufacture of a medicament for the treatment or prevention of a disease, disorder, or other medical condition described herein, for example, but not limited to, chronic pain, acute pain, or persistent pain, or any of the pain syndromes described herein.

Such pharmaceutical compositions can be configured for administration to a patient by a wide variety of delivery routes, e.g., an intravascular delivery route such as by injection or infusion, subcutaneous ("s.c."), intravenous ("i.v."), intramuscular, intraperitoneal ("i.p."), epidural, or intrathecal delivery routes, or for oral, enteral, pulmonary (e.g., inhalant), intranasal, transmucosal (e.g., sublingual administration), transdermal or other delivery routes and/or forms of administration known in the art. Delivery of a drug or pharmaceutical composition containing a JzTx-V peptide analog, or other compositions of matter of the invention, may take place via standard injectable modalities, whether self-administered or in hospital setting, or also via an implantable delivery pump to achieve the most accurate dosing and the most stable plasma exposure levels. The inventive pharmaceutical compositions may be prepared in liquid form, or may be in dried powder form, such as lyophilized form, or crystalline form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

Pharmaceutical Compositions

In General.

The present invention also provides pharmaceutical compositions comprising the inventive composition of matter and a pharmaceutically acceptable carrier. Such pharmaceutical compositions can be configured for administration to a patient by a wide variety of delivery routes, e.g., an intravascular delivery route such as by injection or infusion, subcutaneous, intramuscular, intraperitoneal, epidural, or intrathecal delivery routes, or for oral, enteral, pulmonary (e.g., inhalant), intranasal, transmucosal (e.g., sublingual administration), transdermal or other delivery routes and/or forms of administration known in the art. The inventive pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In the practice of this invention the "pharmaceutically acceptable carrier" is any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination. Such pharmaceutical compositions can include diluents of various buffer content (e.g., Tris-HCl, acetate, phosphate), pH and ionic strength; additives such as detergents and solubilizing agents (e.g., Tween® 80, Polysorbate 80), anti-oxidants (e.g., ascorbic acid, sodium metabisulfite), preservatives (e.g., Thimersol®, benzyl alcohol) and bulking substances (e.g., lactose, mannitol); incorporation of the material into particulate preparations of polymeric compounds such as polylactic acid, polyglycolic acid, etc. or into liposomes. Hyaluronic acid can also be used, and this can have the effect of promoting sustained duration in the circulation. Such compositions can influence the physical state, stability, rate of in vivo release, and rate of in vivo clearance of the present proteins and derivatives. See, e.g., *Remington's Pharmaceutical Sciences,* 18th Ed. (1990, Mack Publishing Co., Easton, Pa. 18042) pages 1435-1712, which are herein incorporated by reference in their entirety. The compositions can be prepared in liquid form, or can be in dried powder, such as lyophilized form. Implantable sustained release formulations are also useful, as are transdermal or transmucosal formulations. Additionally (or alternatively), the present invention provides compositions for use in any of the various slow or sustained release formulations or microparticle formulations known to the skilled artisan, for example, sustained release microparticle formulations, which can be administered via pulmonary, intranasal, or subcutaneous delivery routes. (See, e.g., Murthy et al., Injectable compositions for the controlled delivery of pharmacologically active compound, U.S. Pat. No. 6,887,487; Manning et al., Solubilization of pharmaceutical substances in an organic solvent and preparation of pharmaceutical powders using the same, U.S. Pat. Nos. 5,770,559 and 5,981,474; Lieberman et al., Lipophilic complexes of pharmacologically active inorganic mineral acid esters of organic compounds, U.S. Pat. No. 5,002,936; Gen, Formative agent of protein complex, US 2002/0119946 A1; Goldenberg et al., Sustained release formulations, WO 2005/105057 A1).

One can dilute the inventive compositions or increase the volume of the pharmaceutical compositions of the invention with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride. Some commercially available diluents are Fast-Flo, Emdex, STA-Rx 1500, Emcompress and Avicell.

A variety of conventional thickeners are useful in creams, ointments, suppository and gel configurations of the pharmaceutical composition, such as, but not limited to, alginate, xanthan gum, or petrolatum, may also be employed in such configurations of the pharmaceutical composition of the present invention. A permeation or penetration enhancer, such as polyethylene glycol monolaurate, dimethyl sulfoxide, N-vinyl-2-pyrrolidone, N-(2-hydroxyethyl)-pyrrolidone, or 3-hydroxy-N-methyl-2-pyrrolidone can also be employed. Useful techniques for producing hydrogel matrices are known. (E.g., Feijen, Biodegradable hydrogel matrices for the controlled release of pharmacologically active agents, U.S. Pat. No. 4,925,677; Shah et al., Biodegradable pH/thermosensitive hydrogels for sustained delivery of biologically active agents, WO 00/38651 A1). Such biodegradable gel matrices can be formed, for example, by crosslinking a proteinaceous component and a polysaccharide or mucopolysaccharide component, then loading with the inventive composition of matter to be delivered.

Liquid pharmaceutical compositions of the present invention that are sterile solutions or suspensions can be administered to a patient by injection, for example, intramuscularly, intrathecally, epidurally, intravascularly (e.g., intravenously or intraarterially), intraperitoneally or subcutaneously. (See, e.g., Goldenberg et al., Suspensions for the sustained release of proteins, U.S. Pat. No. 6,245,740 and WO 00/38652 A1). Sterile solutions can also be administered by intravenous infusion. The inventive composition can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also useful embodiments of the inventive pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, Biodegradable, implantable drug delivery device, and process for preparing and using same, U.S. Pat. No. 4,351,337). Other techniques for making implants for delivery of drugs are also known and useful in accordance with the present invention.

In powder forms, the pharmaceutically acceptable carrier is a finely divided solid, which is in admixture with finely divided active ingredient(s), including the inventive composition. For example, in some embodiments, a powder form is useful when the pharmaceutical composition is configured as an inhalant. (See, e.g., Zeng et al., Method of preparing dry powder inhalation compositions, WO 2004/017918; Trunk et al., Salts of the CGRP antagonist BIBN4096 and inhalable powdered medicaments containing them, U.S. Pat. No. 6,900,317).

One can dilute or increase the volume of the compound of the invention with an inert material. These diluents could include carbohydrates, especially mannitol, α-lactose, anhydrous lactose, cellulose, sucrose, modified dextrans and starch. Certain inorganic salts can also be used as fillers including calcium triphosphate, magnesium carbonate and sodium chloride. Some commercially available diluents are Fast-Flo™ Emdex™, STA-Rx™ 1500, Emcompress™ and Avicell™.

Disintegrants can be included in the formulation of the pharmaceutical composition into a solid dosage form. Materials used as disintegrants include but are not limited to starch including the commercial disintegrant based on starch, Explotab™. Sodium starch glycolate, Amberlite™, sodium carboxymethylcellulose, ultramylopectin, sodium alginate, gelatin, orange peel, acid carboxymethyl cellulose, natural sponge and bentonite can all be used. Insoluble cationic exchange resin is another form of disintegrant. Powdered gums can be used as disintegrants and as binders and these can include powdered gums such as agar, Karaya or tragacanth. Alginic acid and its sodium salt are also useful as disintegrants.

Binders can be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic. An antifrictional agent can be included in the formulation of the therapeutic to prevent sticking during the formulation process. Lubricants can be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants can also be used such as sodium lauryl sulfate, magnesium lauryl sulfate, polyethylene glycol of various molecular weights, Carbowax 4000 and 6000.

Glidants that might improve the flow properties of the drug during formulation and to aid rearrangement during compression might be added. The glidants can include starch, talc, pyrogenic silica and hydrated silicoaluminate.

To aid dissolution of the compound of this invention into the aqueous environment a surfactant might be added as a wetting agent. Surfactants can include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the protein or derivative either alone or as a mixture in different ratios.

Oral Dosage Forms.

Also useful are oral dosage forms of the inventive compositions. If necessary, the composition can be chemically modified so that oral delivery is efficacious. Generally, the chemical modification contemplated is the attachment of at least one moiety to the molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached half-life extending moieties in this invention can also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis (1981), *Soluble Polymer—Enzyme Adducts, Enzymes as Drugs* (Hocenberg and Roberts, eds.), Wiley-Interscience, New York, N.Y., pp 367-83; Newmark, et al. (1982), *J. Appl. Biochem.* 4:185-9. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl]amino) caprylate (SNAC), as a carrier to enhance absorption of the therapeutic compounds of this invention. The clinical efficacy of a heparin formulation using SNAC has been demonstrated in a Phase II trial conducted by Emisphere Technologies. See U.S. Pat. No. 5,792,451, "Oral drug delivery composition and methods."

In one embodiment, the pharmaceutically acceptable carrier can be a liquid and the pharmaceutical composition is prepared in the form of a solution, suspension, emulsion, syrup, elixir or pressurized composition. The active ingredient(s) (e.g., the inventive composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators. Additives can also be included in the formulation to enhance uptake of the inventive composition. Additives potentially having this property are for instance the fatty acids oleic acid, linoleic acid and linolenic acid.

Useful are oral solid dosage forms, which are described generally in *Remington's Pharmaceutical Sciences* (1990), supra, in Chapter 89, which is hereby incorporated by reference in its entirety. Solid dosage forms include tablets, capsules, pills, troches or lozenges, cachets or pellets. Also, liposomal or proteinoid encapsulation can be used to formulate the present compositions (as, for example, proteinoid microspheres reported in U.S. Pat. No. 4,925,673). Liposomal encapsulation can be used and the liposomes can be derivatized with various polymers (e.g., U.S. Pat. No. 5,013,556). A description of possible solid dosage forms for the therapeutic is given in Marshall, K., *Modern Pharmaceutics* (1979), edited by G. S. Banker and C. T. Rhodes, in Chapter 10, which is hereby incorporated by reference in its entirety. In general, the formulation will include the inventive compound, and inert ingredients that allow for protection against the stomach environment, and release of the biologically active material in the intestine.

The composition of this invention can be included in the formulation as fine multiparticulates in the form of granules or pellets of particle size about 1 mm. The formulation of the material for capsule administration could also be as a powder, lightly compressed plugs or even as tablets. The therapeutic could be prepared by compression.

Colorants and flavoring agents can all be included. For example, the protein (or derivative) can be formulated (such as by liposome or microsphere encapsulation) and then further contained within an edible product, such as a refrigerated beverage containing colorants and flavoring agents.

In tablet form, the active ingredient(s) are mixed with a pharmaceutically acceptable carrier having the necessary compression properties in suitable proportions and compacted in the shape and size desired.

The powders and tablets preferably contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

Controlled release formulation can be desirable. The composition of this invention can be incorporated into an inert matrix that permits release by either diffusion or leaching mechanisms e.g., gums. Slowly degenerating matrices can also be incorporated into the formulation, e.g., alginates, polysaccharides. Another form of a controlled release of the compositions of this invention is by a method based on the Oros™ therapeutic system (Alza Corp.), i.e., the drug is enclosed in a semipermeable membrane which allows water to enter and push drug out through a single small opening due to osmotic effects. Some enteric coatings also have a delayed release effect.

Other coatings can be used for the formulation. These include a variety of sugars that could be applied in a coating pan. The therapeutic agent could also be given in a film-coated tablet and the materials used in this instance are divided into 2 groups. The first are the nonenteric materials and include methylcellulose, ethyl cellulose, hydroxyethyl cellulose, methylhydroxy-ethyl cellulose, hydroxypropyl cellulose, hydroxypropyl-methyl cellulose, sodium carboxymethyl cellulose, providone and the polyethylene glycols. The second group consists of the enteric materials that are commonly esters of phthalic acid.

A mix of materials might be used to provide the optimum film coating. Film coating can be carried out in a pan coater or in a fluidized bed or by compression coating.

Pulmonary Delivery Forms.

Pulmonary delivery of the inventive compositions is also useful. The protein (or derivative) is delivered to the lungs of a mammal while inhaling and traverses across the lung epithelial lining to the blood stream. (Other reports of this include Adjei et al., *Pharma. Res.* (1990) 7: 565-9; Adjei et al. (1990), *Internatl. J. Pharmaceutics* 63: 135-44 (leuprolide acetate); Braquet et al. (1989), *J. Cardiovasc. Pharmacol.* 13 (suppl. 5): s. 143-146 (endothelin-1); Hubbard et al. (1989), *Annals Int. Med.* 3: 206-12 (α1-antitrypsin); Smith et al. (1989), *J. Clin. Invest.* 84: 1145-6 (α1-proteinase); Oswein et al. (March 1990), "Aerosolization of Proteins," *Proc. Symp. Resp. Drug Delivery II*, Keystone, Colo. (recombinant human growth hormone); Debs et al. (1988), *J. Immunol.* 140: 3482-8 (interferon-γ and tumor necrosis factor α) and Platz et al., U.S. Pat. No. 5,284,656 (granulocyte colony stimulating factor).

Useful in the practice of this invention are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass. (See, e.g., Helgesson et al., Inhalation device, U.S. Pat. No. 6,892,728; McDerment et al., Dry powder inhaler, WO 02/11801 A1; Ohki et al., Inhalant medicator, U.S. Pat. No. 6,273,086). All such devices require the use of formulations suitable for the dispensing of the inventive compound. Typically, each formulation is specific to the type of device employed and can involve the use of an appropriate propellant material, in addition to diluents, adjuvants and/or carriers useful in therapy.

The inventive compound should most advantageously be prepared in particulate form with an average particle size of less than 10 μm (or microns), most preferably 0.5 to 5 μm, for most effective delivery to the distal lung.

Pharmaceutically acceptable excipients include carbohydrates such as trehalose, mannitol, xylitol, sucrose, lactose, and sorbitol. Other ingredients for use in formulations can include DPPC, DOPE, DSPC and DOPC. Natural or synthetic surfactants can be used. PEG can be used (even apart from its use in derivatizing the protein or analog). Dextrans, such as cyclodextran, can be used. Bile salts and other related enhancers can be used. Cellulose and cellulose derivatives can be used Amino acids can be used, such as use in a buffer formulation.

Also, the use of liposomes, microcapsules or microspheres, inclusion complexes, or other types of carriers is contemplated.

Formulations suitable for use with a nebulizer, either jet or ultrasonic, will typically comprise the inventive compound dissolved in water at a concentration of about 0.1 to 25 mg of biologically active protein per mL of solution. The formulation can also include a buffer and a simple sugar (e.g., for protein stabilization and regulation of osmotic pressure). The nebulizer formulation can also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant can be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid can also be useful as a surfactant. (See, e.g., Bäckström et al., Aerosol drug formulations containing hydrofluoroalkanes and alkyl saccharides, U.S. Pat. No. 6,932,962).

Formulations for dispensing from a powder inhaler device will comprise a finely divided dry powder containing the inventive compound and can also include a bulking agent, such as lactose, sorbitol, sucrose, mannitol, trehalose, or xylitol in amounts which facilitate dispersal of the powder from the device, e.g., 50 to 90% by weight of the formulation.

Nasal Delivery Forms.

In accordance with the present invention, intranasal delivery of the inventive composition of matter and/or pharmaceutical compositions is also useful, which allows passage thereof to the blood stream directly after administration to the inside of the nose, without the necessity for deposition of the product in the lung. Formulations suitable for intransal administration include those with dextran or cyclodextran, and intranasal delivery devices are known. (See, e.g, Freezer, Inhaler, U.S. Pat. No. 4,083,368).

Transdermal and Transmucosal (e.g., Buccal) Delivery Forms).

In some embodiments, the inventive composition is configured as a part of a pharmaceutically acceptable transdermal or transmucosal patch or a troche. Transdermal patch drug delivery systems, for example, matrix type transdermal patches, are known and useful for practicing some embodiments of the present pharmaceutical compositions. (E.g., Chien et al., Transdermal estrogen/progestin dosage unit, system and process, U.S. Pat. Nos. 4,906,169 and 5,023,084; Cleary et al., Diffusion matrix for transdermal drug administration and transdermal drug delivery devices including same, U.S. Pat. No. 4,911,916; Teillaud et al., EVA-based transdermal matrix system for the administration of an estrogen and/or a progestogen, U.S. Pat. No. 5,605,702; Venkateshwaran et al., Transdermal drug delivery matrix for coadministering estradiol and another steroid, U.S. Pat. No. 5,783,208; Ebert et al., Methods for providing testosterone and optionally estrogen replacement therapy to women, U.S. Pat. No. 5,460,820). A variety of pharmaceutically acceptable systems for transmucosal delivery of therapeutic agents are also known in the art and are compatible with the practice of the present invention. (E.g., Heiber et al., Transmucosal delivery of macromolecular drugs, U.S. Pat. Nos. 5,346,701 and 5,516,523; Longenecker et al., Transmembrane formulations for drug administration, U.S. Pat. No. 4,994,439).

Buccal delivery of the inventive compositions is also useful. Buccal delivery formulations are known in the art for use with peptides. For example, known tablet or patch systems configured for drug delivery through the oral mucosa (e.g., sublingual mucosa), include some embodiments that comprise an inner layer containing the drug, a permeation enhancer, such as a bile salt or fusidate, and a hydrophilic polymer, such as hydroxypropyl cellulose, hydroxypropyl methylcellulose, hydroxyethyl cellulose, dextran, pectin, polyvinyl pyrrolidone, starch, gelatin, or any number of other polymers known to be useful for this purpose. This inner layer can have one surface adapted to contact and adhere to the moist mucosal tissue of the oral cavity and can have an opposing surface adhering to an overlying non-adhesive inert layer. Optionally, such a transmucosal delivery system can be in the form of a bilayer tablet, in which the inner layer also contains additional binding agents, flavoring agents, or fillers. Some useful systems employ a non-ionic detergent along with a permeation enhancer. Transmucosal delivery devices may be in free form, such as a cream, gel, or ointment, or may comprise a determinate form such as a tablet, patch or troche. For example, delivery of the inventive composition can be via a transmucosal delivery system comprising a laminated composite of, for example, an adhesive layer, a backing layer, a permeable membrane defining a reservoir containing the inventive composition, a peel seal disc underlying the membrane, one or more heat seals, and a removable release liner. (E.g., Ebert et al., Transdermal delivery system with adhesive overlay and peel seal disc, U.S. Pat. No. 5,662,925; Chang et al., Device for administering an active agent to the skin or mucosa, U.S. Pat. Nos. 4,849,224 and 4,983,395). These examples are merely illustrative of available transmucosal drug delivery technology and are not limiting of the present invention.

Dosages.

The dosage regimen involved in a method for treating the above-described conditions will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1-1000 micrograms of the inventive compound per kilogram of body weight, preferably 0.1-150 micrograms per kilogram.

By way of further illustration, the following numbered embodiments are encompassed by the present invention:

1. A composition of matter comprising an isolated polypeptide comprising the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}Asp^{12}X_{aa}^{13}X_{aa}^{14}X_{aa}^{15}X_{aa}^{16}X_{aa}^{17}X_{aa}^{18}X_{aa}^{19}X_{aa}^{20}Leu^{21}X_{aa}^{22}X_{aa}^{23}X_{aa}^{24}X_{aa}^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}//$$ SEQ ID NO:590 or a pharmaceutically acceptable salt thereof,
wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic or neutral hydrophilic amino acid residue;

$X_{aa}^{7}$ is a Trp, 5-bromoTrp, 6-bromoTrp, 5-chloroTrp, 6-chloroTrp, 1-Nal, 2-Nal, thioTrp, BhPhe, 2-BrhF, 2-ClhF, 2-FhF, 2-MehF, 2-MeOhF, 3-BrhF, 3-ClhF, 3-FhF, 3-MehF, 3-MeOhF, 4-BrhF, 4-ClhF, 4-FhF, 4-Me-F, 4-MehF, 4-MeOhF residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $Xaa^{23}$ is Cys; or $X_{aa}^{11}$ is SeCys if $X_{aa}^{23}$ is SeCys;

$X_{aa}^{13}$ is any amino acid residue;

$X_{aa}^{14}$ is a basic or acidic residue or an Ala residue;

$X_{aa}^{15}$ is an Arg or Cit residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly, Asp or Ala residue;

$X_{aa}^{22}$ is an acidic, basic, or neutral hydrophilic amino acid residue, or Ala or Val residue;

$X_{aa}^{23}$ is a Cys or SeCys residue;

$X_{aa}^{24}$ is a basic or neutral hydrophilic amino acid or Ala residue;

$X_{aa}^{25}$ is an aliphatic hydrophobic residue;

$X_{aa}^{26}$ is a Trp, 5-bromoTrp, 6-bromoTrp, 5-chloroTrp, 6-chloroTrp, 7-BrW, 1-Nal, 2-Nal, thioTrp, 5-phenyl-Trp, 5-iPrTrp, 5-ethylTrp, or 5-MeTrp residue;

$X_{aa}^{27}$ is a Cys or SeCys residue;

$X_{aa}^{28}$ is a basic or neutral hydrophilic amino acid residue;

$X_{aa}^{29}$ is a basic amino acid residue, or a Tyr or Leu residue;

$X_{aa}^{30}$ is an Ile, Trp, Tyr, 5-bromoTrp, 6-bromoTrp, 5-chloroTrp, 6-chloroTrp, thioTrp, 1-Nal, or 2-Nal residue, if $X_{aa}^{22}$ is an acidic amino acid residue; or $X_{aa}^{30}$ is an acidic amino acid residue or a Pro residue, if $X_{aa}^{22}$ is a basic or neutral hydrophilic amino acid residue or an Ala or Val residue;

$X_{aa}^{31}$ is an Ile, Trp, Phe, BhPhe, Cha, Tyr, 5-bromoTrp, 6-bromoTrp, 5-chloroTrp, 6-chloroTrp, 1-Nal, 2-Nal, thioTrp, or 4-tBu-F residue;

each of $X_{aa}^{32}$, $X_{aa}^{33}$, and $X_{aa}^{34}$ is independently absent or is independently a hydrophobic or acidic amino acid residue, or a Ser or Gly residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

2. The composition of matter of Embodiment 1, wherein one or more of $X_{aa}^{14}$, $X_{aa}^{16}$, or $X_{aa}^{22}$ is an acidic amino acid residue.

3. The composition of matter of Embodiment 2, wherein the acidic amino acid residue is selected from Glu, Asp, phosphoserine, phosphotyrosine, and gamma-carboxyglutamic acid residues.

4. The composition of matter of Embodiments 1-3, wherein $X_{aa}^{14}$, $X_{aa}^{16}$, or $X_{aa}^{22}$ is a Glu residue.

5. The composition of matter of any of Embodiments 2-4, wherein $X_{aa}^{30}$ is an Ile, Trp, or Tyr residue.

6. The composition of matter of Embodiment 1, wherein $X_{aa}^{22}$ is a basic or neutral hydrophilic amino acid residue or an Ala or Val residue.

7. The composition of matter of Embodiment 6, wherein $X_{aa}^{22}$ is selected from histidine, lysine, homolysine, ornithine, arginine, N-methyl-arginine, ω-aminoarginine, ω-methyl-arginine, 1-methyl-histidine, 3-methyl-histidine, homoarginine, Ala, Cit, or Val residues, and $X_{aa}^{30}$ is selected from Glu, Asp, phosphoserine, phosphotyrosine, and gamma-carboxyglutamic acid residues.

8. The composition of matter of Embodiment 1, wherein $X_{aa}^{22}$ is an Arg residue, a Cit residue, a Val residue, or Ala residue, and $X_{aa}^{30}$ is a Glu residue.

9. The composition of matter of any of Embodiment 6 or Embodiment 7, wherein $X_{aa}^{30}$ is selected from Glu, Asp, phosphoserine, phosphotyrosine, and gamma-carboxyglutamic acid residues.

10. The composition of matter of Embodiment 9, wherein $X_{aa}^{30}$ is a Glu residue.

11. The composition of matter of Embodiments 1-10, wherein $X_{aa}^{28}$ is a Cit residue.

12. The composition of matter of Embodiments 1-11, wherein $X_{aa}^{31}$ is an Ile, Trp, Cha, Phe, BhPhe, or Tyr residue.

13. The composition of matter of Embodiments 1-12, wherein $X_{aa}^{1}$ is a Pra, Aha, Abu, Nva, Nle, Sar, hLeu, hPhe, D-Leu, D-Phe, D-Ala, bAla, AllylG, CyA, or Atz residue.

14. The composition of matter of Embodiments 1-13, wherein $X_{aa}^{1}$ is absent; or $X_{aa}^{1}$ is any amino acid residue; and $X_{aa}^{2}$ is any hydrophobic or acidic amino acid residue, or a Pra, hPra, bhPra, ethynylphenylalanine (EPA), (S)-2-amino-4-hexynoic acid, Aha, Abu, Nva, Nle, Sar, hLeu, hPhe, D-Leu, D-Phe, D-Ala, bAla, AllylG, CyA, or Atz residue.

15. The composition of matter of Embodiment 14, wherein $X_{aa}^{20}$ is a Gly or Ala residue.

16. The composition of matter of Embodiments 14-15, wherein $X_{aa}^{6}$ is a basic amino acid residue.

17. The composition of matter of Embodiments 14-16, wherein $X_{aa}^{2}$ is a Pra, hPra, bhPra, EPA, Aha, (S)-2-amino-4-hexynoic acid, Abu, Nva, Nle, Sar, hLeu, hPhe, D-Leu, D-Phe, D-Ala, bAla, AllylG, CyA, Atz, Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, or 4-phenyl-phenylalanine (Bip) residue.

18. The composition of matter of Embodiments 14-16, wherein $X_{aa}^{2}$ is an acidic amino acid residue.

19. The composition of matter of Embodiments 14-18, wherein $X_{aa}^{30}$ is an acidic amino acid residue.

20. The composition of matter of Embodiments 14-18, wherein $X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue.

21. The composition of matter of Embodiments 14-20, wherein $X_{aa}^{3}$ is an acidic amino acid residue.

22. The composition of matter of Embodiments 14-20, wherein $X_{aa}^{13}$ is an acidic amino acid residue.

23. The composition of matter of Embodiments 14-20, wherein $X_{aa}^{14}$ is an acidic amino acid residue.

24. The composition of matter of Embodiments 14-20, wherein $X_{aa}^{15}$ is a Cit residue.

25. The composition of matter of Embodiments 14-20, wherein $X_{aa}^{16}$ is an acidic amino acid residue.

26. The composition of matter of Embodiments 14-20, wherein $X_{aa}^{19}$ is an acidic amino acid residue.

27. The composition of matter of Embodiments 14-20, wherein $X_{aa}^{22}$ is a neutral hydrophilic amino acid residue, a Val residue, or an Ala residue.

28. The composition of matter of Embodiments 14-20, wherein $X_{aa}^{24}$ is a neutral hydrophilic amino acid residue.

29. The composition of matter of Embodiments 14-20, wherein $X_{aa}^{28}$ is a neutral hydrophilic amino acid residue.

30. The composition of matter of any of Embodiments 14-29, wherein $X_{aa}^{30}$ is an Ile, Trp, or Tyr residue.

31. The composition of matter of Embodiments 1-30, wherein $X_{aa}^{8}$ is an Nle or Leu residue.

32. The composition of matter of Embodiments 1-31, wherein the carboxy-terminal residue is amidated.

33. The composition of matter of Embodiment 1, comprising an amino acid sequence selected from SEQ ID NO:63, SEQ ID NO:69, SEQ ID NO:110, SEQ ID NO:111, SEQ ID NO:112, SEQ ID NO:113, SEQ ID NO:114, SEQ ID NO:115, SEQ ID NO:131, SEQ ID NO:137, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:149, SEQ ID NO:150, SEQ ID NO:152, SEQ ID NO:153, SEQ ID NO:154, SEQ ID NO:157, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:174, SEQ ID NO:175, SEQ ID NO:177, SEQ ID NO:178, SEQ ID NO:179, SEQ ID NO:182, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:273, SEQ ID NO:274, SEQ ID NO:277, SEQ ID NO:279, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:333, SEQ ID NO:334, SEQ ID NO:335, SEQ ID NO:336, SEQ ID NO:337, SEQ ID NO:338, SEQ ID NO:339, SEQ ID NO:340, SEQ ID NO:341, SEQ ID NO:342, SEQ ID NO:343, SEQ ID NO:344, SEQ ID NO:345, SEQ ID NO:346, SEQ ID NO:347, SEQ ID NO:348, SEQ ID NO:349, SEQ ID NO:350, SEQ ID NO:351, SEQ ID NO:352, SEQ ID NO:353, SEQ ID NO:354, SEQ ID NO:355, SEQ ID NO:356, SEQ ID NO:392, SEQ ID NO:393, SEQ ID NO:394, SEQ ID NO:395, SEQ ID NO:396, SEQ ID NO:397, SEQ ID NO:406, SEQ ID NO:407, SEQ ID NO:408, SEQ ID NO:409, SEQ ID NO:411, SEQ ID NO:412, SEQ ID NO:413, SEQ ID NO:414, SEQ ID NO:415, SEQ ID NO:416, SEQ ID NO:417, SEQ ID NO:418, SEQ ID NO:419, SEQ ID NO:420, SEQ ID NO:421, SEQ ID NO:422, SEQ ID NO:426, SEQ ID NO:435, SEQ ID NO:436, SEQ ID NO:437, SEQ ID NO:439, SEQ ID NO:440, SEQ ID NO:441, SEQ ID NO:442, SEQ ID NO:443, SEQ ID NO:444, SEQ ID NO:445, SEQ ID NO:447, SEQ ID NO:448, SEQ ID NO:449, SEQ ID NO:450, SEQ ID NO:451, SEQ ID NO:452, SEQ ID NO:455, SEQ ID NO:456, SEQ ID NO:457, SEQ ID NO:458, SEQ ID NO:459, SEQ ID NO:460, SEQ ID NO:461, SEQ ID NO:462, SEQ ID NO:463, SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, SEQ ID NO:473, SEQ ID NO:474, SEQ ID NO:475, SEQ ID NO:518, SEQ ID NO:520, SEQ ID NO:521, SEQ ID NO:523, SEQ ID NO:524, SEQ ID NO:526, SEQ ID NO:527, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:565, SEQ ID NO:566, SEQ ID NO:568, SEQ ID NO:573, SEQ ID NO:574, SEQ ID NO:576, SEQ ID NO:577, SEQ ID NOS: 578-588, SEQ ID NO:597, SEQ ID NO:605, SEQ ID NO:614, SEQ ID NO:615, SEQ ID NO:635, SEQ ID NO:636, SEQ ID NO:640, SEQ ID NO:641, SEQ ID NO:642, SEQ ID NO:643, SEQ ID NO:644, SEQ ID NO:645, SEQ ID NO:657, SEQ ID NO:667, SEQ ID NO:687, SEQ ID NO:688, SEQ ID NOS: 692-697, SEQ ID NO:701, SEQ ID NO:702, SEQ ID NO:707, SEQ ID NO:708, SEQ ID NO:709, SEQ ID NOS: 714-718, SEQ ID NO:721, SEQ ID NO:723, SEQ ID NOS: 726-729, SEQ ID NOS: 731-757, SEQ ID NOS: 764-785, SEQ ID NO:789, SEQ ID NO:790, SEQ ID NO:791, SEQ ID NOS: 795-801, SEQ ID NO:803, SEQ ID NO:804, SEQ ID NO:805, SEQ ID NO:807, SEQ ID NO:808, SEQ ID NO:809, SEQ ID NO:814, SEQ ID NOS: 816-824, SEQ ID NO:828, SEQ ID NO:829, SEQ ID NO:831, SEQ ID NO:833, SEQ ID NOS: 835-870, SEQ ID NOS: 873-885, SEQ ID NOS: 888-909, SEQ ID NO:911, SEQ ID NO:912, SEQ ID NO:913, SEQ ID NO:923, SEQ ID NO:924, SEQ ID NO:925, SEQ ID NO:929, SEQ ID NO:930, SEQ ID NO:931, SEQ ID NOS: 941-984, SEQ ID NOS: 986-1033, SEQ ID NOS: 1136-1188, SEQ ID NOS: 1190-1242, SEQ ID NO:1350, SEQ ID NO:1351, SEQ ID NO:1352, SEQ ID NO:1353, SEQ ID NOS: 1358-1369, SEQ ID NOS: 1382-1393, SEQ ID NOS: 1406-1417, SEQ ID NO:1430, SEQ ID NOS: 1432-1443, SEQ ID NOS: 1456-1467, SEQ ID NOS: 1480-1491, SEQ ID NOS: 1510-1515, SEQ ID NOS: 1522-1527, SEQ ID NOS: 1534-1611, SEQ ID NO:1613, SEQ ID NOS: 1615-1640, SEQ ID NO:1644, SEQ ID NO:1645, and SEQ ID NOS: 1649-1694.

34. The composition of matter of Embodiment 1, comprising an amino acid sequence selected from SEQ ID NO:715, SEQ ID NO:728, SEQ ID NO:732, SEQ ID NO:735, SEQ ID NO:737, SEQ ID NO:742, SEQ ID NO:744, SEQ ID NO:746, SEQ ID NO:747, SEQ ID NO:748, SEQ ID NO:749, SEQ ID NO:753, SEQ ID NO:754, SEQ ID NO:755, SEQ ID NO:756, SEQ ID NO:757, SEQ ID NO:835, SEQ ID NO:836, SEQ ID NO:837, SEQ ID NO:953, SEQ ID NO:954, SEQ ID NO:955, SEQ ID NO:956, SEQ ID NO:957, SEQ ID NO:969, SEQ ID NO:970, SEQ ID NO:971, SEQ ID NO:972, SEQ ID NO:973, SEQ ID NO:974, SEQ ID NO:975, SEQ ID NO:976, SEQ ID NO:977, SEQ ID NO:978, SEQ ID NO:979, SEQ ID NO:980, SEQ ID NO:981, SEQ ID NO:982, SEQ ID NO:983, SEQ ID NO:984, SEQ ID NO:1002, SEQ ID NO:1003, SEQ ID NO:1004, SEQ ID NO:1005, SEQ ID NO:1006, SEQ ID NO:1018, SEQ ID NO:1019, SEQ ID NO:1020, SEQ ID NO:1021, SEQ ID NO:1022, SEQ ID NO:1023, SEQ ID NO:1024, SEQ ID NO:1025, SEQ ID NO:1026, SEQ ID NO:1027, SEQ ID NO:1028, SEQ ID NO:1029, SEQ ID NO:1030, SEQ ID NO:1031, SEQ ID NO:1032, SEQ ID NO:1137, SEQ ID NO:1157, SEQ ID NO:1158, SEQ ID NO:1159, SEQ ID NO:1160, SEQ ID NO:1161, SEQ ID NO:1173, SEQ ID NO:1174, SEQ ID NO:1175, SEQ ID NO:1176, SEQ ID NO:1177, SEQ ID NO:1178, SEQ ID NO:1179, SEQ ID NO:1180, SEQ ID NO:1181, SEQ ID NO:1182, SEQ ID NO:1183, SEQ ID NO:1184, SEQ ID NO:1185, SEQ ID NO:1186, SEQ ID NO:1187, SEQ ID NO:1188, SEQ ID NO:1191, SEQ ID NO:1211, SEQ ID NO:1212, SEQ ID NO:1213, SEQ ID NO:1214, SEQ ID NO:1225, SEQ ID NO:1227, SEQ ID NO:1228, SEQ ID NO:1229, SEQ ID NO:1230, SEQ ID NO:1231, SEQ ID NO:1232, SEQ ID NO:1233, SEQ ID NO:1234, SEQ ID NO:1235, SEQ ID NO:1236, SEQ ID NO:1237, SEQ ID NO:1238, SEQ ID NO:1239, SEQ ID NO:1240, SEQ ID NO:1241, SEQ ID NO:1242, SEQ ID NO:1351, SEQ ID NO:1353, SEQ ID NO:1360, SEQ ID NO:1362, SEQ ID NO:1363, SEQ ID NO:1366, SEQ ID NO:1368, SEQ ID NO:1369, SEQ ID NO:1384, SEQ ID NO:1386, SEQ ID NO:1387, SEQ ID NO:1390, SEQ ID NO:1392, SEQ ID NO:1393, SEQ ID NO:1408, SEQ ID NO:1410, SEQ ID NO:1411, SEQ ID NO:1414, SEQ ID NO:1416, SEQ ID NO:1417, SEQ ID NO:1434, SEQ ID NO:1436, SEQ ID NO:1437, SEQ ID NO:1440, SEQ ID NO:1442, SEQ ID NO:1443, SEQ ID NO:1458, SEQ ID NO:1460, SEQ ID NO:1461, SEQ ID NO:1464, SEQ ID NO:1466, SEQ ID NO:1467, SEQ ID NO:1482, SEQ ID NO:1484, SEQ ID NO:1485, SEQ ID NO:1488, SEQ ID NO:1490, SEQ ID NO:1491, SEQ ID NO:1628, SEQ ID NO:1629, SEQ ID NO:1673, SEQ ID NO:1674, SEQ ID NO:1677, SEQ ID NO:1678, SEQ ID NO:1683, SEQ ID NO:1686, and SEQ ID NO:1687.

35. The composition of matter of Embodiment 1, comprising an amino acid sequence selected from SEQ ID NO:717, SEQ ID NO:733, SEQ ID NO:738, SEQ ID NO:740, SEQ ID NO:743, SEQ ID NO:745, SEQ ID NO:747, SEQ ID NO:749, SEQ ID NO:750, SEQ ID NO:751, SEQ ID NO:752, SEQ ID NO:753, SEQ ID NO:755, SEQ ID NO:756, SEQ ID NO:757, SEQ ID NO:770, SEQ ID NO:771, SEQ ID NO:773, SEQ ID NO:958, SEQ ID NO:959, SEQ ID NO:960, SEQ ID NO:961, SEQ ID NO:962, SEQ ID NO:963, SEQ ID NO:1138, SEQ ID NO:1162, SEQ ID NO:1163, SEQ ID NO:1164, SEQ ID NO:1165, SEQ ID NO:1166, SEQ ID NO:1167, SEQ ID NO:1192, SEQ ID NO:1361, SEQ ID NO:1367, SEQ ID NO:1385, SEQ ID NO:1391, SEQ ID NO:1409, SEQ ID NO:1415, SEQ ID NO:1430, SEQ ID NO:1435, SEQ ID NO:1441, SEQ ID NO:1459, SEQ ID NO:1465, SEQ ID NO:1483, SEQ ID NO:1489, SEQ ID NO:1596, SEQ ID NO:1597, SEQ ID NO:1598, SEQ ID NO:1600, SEQ ID NO:1602, SEQ ID NO:1645, and SEQ ID NO:1694.

36. The composition of matter of Embodiment 1, comprising an amino acid sequence selected from SEQ ID NO:1137, SEQ ID NO:1157, SEQ ID NO:1158, SEQ ID NO:1159, SEQ ID NO:1160, SEQ ID NO:1161, SEQ ID NO:1173, SEQ ID NO:1174, SEQ ID NO:1175, SEQ ID NO:1176, SEQ ID NO:1177, SEQ ID NO:1178, SEQ ID NO:1179, SEQ ID NO:1180, SEQ ID NO:1181, SEQ ID NO:1182, SEQ ID NO:1183, SEQ ID NO:1184, SEQ ID NO:1185, SEQ ID NO:1186, SEQ ID NO:1187, SEQ ID NO:1188, SEQ ID NO:1191, SEQ ID NO:1211, SEQ ID NO:1212, SEQ ID NO:1213, SEQ ID NO:1214, SEQ ID NO:1215, SEQ ID NO:1227, SEQ ID NO:1228, SEQ ID NO:1229, SEQ ID NO:1230, SEQ ID NO:1231, SEQ ID NO:1232, SEQ ID NO:1233, SEQ ID NO:1234, SEQ ID NO:1235, SEQ ID NO:1236, SEQ ID NO:1237, SEQ ID NO:1238, SEQ ID NO:1239, SEQ ID NO:1240, SEQ ID NO:1241, SEQ ID NO:1242, SEQ ID NO:1351, SEQ ID NO:1353, SEQ ID NO:1360, SEQ ID NO:1362, SEQ ID NO:1363, SEQ ID NO:1366, SEQ ID NO:1368, SEQ ID NO:1369, SEQ ID NO:1384, SEQ ID NO:1386, SEQ ID NO:1387, SEQ ID NO:1390, SEQ ID NO:1392, SEQ ID NO:1393, SEQ ID NO:1408, SEQ ID NO:1410, SEQ ID NO:1411, SEQ ID NO:1414, SEQ ID NO:1416, SEQ ID NO:1417, SEQ ID NO:1434, SEQ ID NO:1436, SEQ ID NO:1437, SEQ ID NO:1440, SEQ ID NO:1442, SEQ ID NO:1443, SEQ ID NO:1458, SEQ ID NO:1460, SEQ ID NO:1461, SEQ ID NO:1464, SEQ ID NO:1466, SEQ ID NO:1467, SEQ ID NO:1482, SEQ ID NO:1484, SEQ ID NO:1485, SEQ ID NO:1488, SEQ ID NO:1490, SEQ ID NO:1491, and SEQ ID NO:1629.

37. The composition of matter of Embodiment 1, comprising an amino acid sequence selected from SEQ ID NO:1138, SEQ ID NO:1162, SEQ ID NO:1163, SEQ ID NO:1164, SEQ ID NO:1165, SEQ ID NO:1166, SEQ ID NO:1167, SEQ ID NO:1192, SEQ ID NO:1361, SEQ ID NO:1367, SEQ ID NO:1385, SEQ ID NO:1391, SEQ ID NO:1409, SEQ ID NO:1415, SEQ ID NO:1430, SEQ ID NO:1435, SEQ ID NO:1441, SEQ ID NO:1459, SEQ ID NO:1465, SEQ ID NO:1483, and SEQ ID NO:1489.

38. The composition of matter of Embodiment 1, comprising an isolated polypeptide comprising the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}\text{Asp}^{12}X_{aa}^{13}X_{aa}^{14}\text{Arg}^{15}X_{aa}^{16}X_{aa}^{17}X_{aa}^{18}X_{aa}^{19}X_{aa}^{20}\text{Leu}^{21}X_{aa}^{22}X_{aa}^{23}X_{aa}^{24}\text{Leu}^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}//$$ SEQ ID NO:516 or a pharmaceutically acceptable salt thereof, wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue; or $X_{aa}^{1}$ is absent and $X_{aa}^{2}$ is absent;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic amino acid residue;

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Met, Nle, Nva, Leu, Ile, Val, or Phe residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue;

$X_{aa}^{14}$ is a basic residue or an Ala residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly or Ala residue;

$X_{aa}^{22}$ is an acidic, basic amino acid residue, or Ala residue;

$X_{aa}^{23}$ is a Cys or SeCys residue;

$X_{aa}^{24}$ is a basic amino acid or Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue;

$X_{aa}^{29}$ is a basic amino acid residue;

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue, if $X_{aa}^{22}$ is an acidic amino acid residue; or $X_{aa}^{30}$ is an acidic amino acid residue, if $X_{aa}^{22}$ is a basic amino acid residue or an Ala residue;

$X_{aa}^{31}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

each of $X_{aa}^{32}$, $X_{aa}^{33}$, and $X_{aa}^{34}$ is independently absent or is independently a hydrophobic amino acid residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

39. The composition of matter of Embodiment 38, wherein $X_{aa}^{22}$ is an acidic amino acid residue.

40. The composition of matter of Embodiment 38, wherein $X_{aa}^{22}$ is a basic amino acid residue or an Ala residue; and $X_{aa}^{30}$ is selected from Glu, Asp, phosphoserine, phosphotyrosine, and gamma-carboxyglutamic acid residues.

41. The composition of matter of Embodiment 40, wherein $X_{aa}^{30}$ is a Glu residue.

42. The composition of matter of Embodiments 38-41, wherein the carboxy-terminal residue is amidated.

43. The composition of matter of Embodiment 1, wherein the composition of matter comprises an isolated polypeptide comprising the amino acid sequence of the formula:

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}\text{Asp}^{12}X_{aa}^{13}X_{aa}^{14}\text{Arg}^{15}X_{aa}^{16}X_{aa}^{17}X_{aa}^{18}X_{aa}^{19}X_{aa}^{20}\text{Leu}^{21}X_{aa}^{22}X_{aa}^{23}X_{aa}^{24}\text{Leu}^{25}X_{aa}^{26}X_{aa}^{27}X_{aa}^{28}X_{aa}^{29}X_{aa}^{30}X_{aa}^{31}X_{aa}^{32}X_{aa}^{33}X_{aa}^{34}//$$ SEQ ID NO:517 or a pharmaceutically acceptable salt thereof, wherein:

$X_{aa}^{1}$ is absent; or $X_{aa}^{1}$ is any amino acid residue;

$X_{aa}^{2}$ is any hydrophobic amino acid residue, or a Pra, Aha, Abu, Nva, Nle, Sar, hLeu, hPhe, D-Leu, D-Phe, D-Ala, bAla, AllylG, CyA, or Atz residue;

$X_{aa}^{3}$ is any amino acid residue;

$X_{aa}^{4}$ is Cys, if $X_{aa}^{18}$ is Cys; or $X_{aa}^{4}$ is SeCys, if $X_{aa}^{18}$ is SeCys;

$X_{aa}^{5}$ is any neutral hydrophilic or basic amino acid residue;

$X_{aa}^{6}$ is any basic amino acid residue;

$X_{aa}^{7}$ is a Trp, 5-bromoTrp, 6-bromoTrp, 5-chloroTrp, 6-chloroTrp, 1-Nal, 2-Nal, or thioTrp residue;

$X_{aa}^{8}$ is a Leu or Nle residue;

$X_{aa}^{9}$ is a Trp, 5-bromoTrp, 6-bromoTrp, 5-chloroTrp, 6-chloroTrp, 1-Nal, 2-Nal, or thioTrp residue;

$X_{aa}^{10}$ is a basic or neutral hydrophilic amino acid residue, or an Ala residue;

$X_{aa}^{11}$ is Cys if $X_{aa}^{23}$ is Cys; or $X_{aa}^{11}$ is SeCys if $X_{aa}^{23}$ is SeCys;

$X_{aa}^{13}$ is any amino acid residue except a hydrophobic residue;

$X_{aa}^{14}$ is a basic residue or an Ala residue;

$X_{aa}^{16}$ is any amino acid residue;

$X_{aa}^{17}$ is a Cys if $X_{aa}^{27}$ is Cys; or $X_{aa}^{17}$ is a SeCys if $X_{aa}^{27}$ is SeCys;

$X_{aa}^{18}$ is a Cys or SeCys;

$X_{aa}^{19}$ is any amino acid residue;

$X_{aa}^{20}$ is a Gly or Ala residue;

$X_{aa}^{22}$ is a basic amino acid residue or Ala residue;

$X_{aa}^{23}$ is a Cys or SeCys residue;

$X_{aa}^{24}$ is a basic amino acid residue or Ala residue;

$X_{aa}^{26}$ is a Trp, 5-bromoTrp, 6-bromoTrp, 5-chloroTrp, 6-chloroTrp, 1-Nal, 2-Nal, or thioTrp residue;

$X_{aa}^{27}$ is a Cys or SeCys residue;

$X_{aa}^{28}$ is a basic amino acid residue;

$X_{aa}^{29}$ is a basic amino acid residue;

$X_{aa}^{30}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

$X_{aa}^{31}$ is an Ile, Trp, Tyr, 5-bromoTrp, 6-bromoTrp, 5-chloroTrp, 6-chloroTrp, 1-Nal, 2-Nal, thioTrp, 1-Nal, or 2-Nal residue;

each of $X_{aa}^{32}$, $X_{aa}^{33}$, and $X_{aa}^{34}$ is independently absent or is independently a hydrophobic amino acid residue;

and wherein:

if $X_{aa}^{4}$ and $X_{aa}^{18}$ are both Cys residues, there is a disulfide bond between residue $X_{aa}^{4}$ and residue $X_{aa}^{18}$; or if $X_{aa}^{4}$ and $X_{aa}^{18}$ are both SeCys residues, there is a diselenide bond between residue $X_{aa}^{4}$ and residue $X_{aa}^{18}$;

if $X_{aa}^{11}$ and $X_{aa}^{23}$ are both Cys residues, there is a disulfide bond between residue $X_{aa}^{11}$ and residue $X_{aa}^{23}$; or if $X_{aa}^{11}$ and $X_{aa}^{23}$ are both SeCys residues, there is a diselenide bond between residue $X_{aa}^{11}$ and residue $X_{aa}^{23}$;

if $X_{aa}^{17}$ and $X_{aa}^{27}$ are both Cys residues, there is a disulfide bond between residue $X_{aa}^{17}$ and residue $X_{aa}^{27}$; or if $X_{aa}^{17}$ and $X_{aa}^{27}$ are both SeCys residues, there is a diselenide bond between residue $X_{aa}^{17}$ and residue $X_{aa}^{27}$;

the amino-terminal residue is optionally acetylated, biotinylated, or 4-pentynoylated, or PEGylated; and the carboxy-terminal residue is optionally amidated.

44. The composition of matter of Embodiment 43, wherein $X_{aa}^{2}$ is a Pra, Aha, Abu, Nva, Nle, Sar, hLeu, hPhe, D-Leu, D-Phe, D-Ala, bAla, AllylG, CyA, Atz, Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethylphenylalanine, or 4-phenyl-phenylalanine (Bip) residue.

45. The composition of matter of any of Embodiments 43-44, wherein $X_{aa}^{30}$ is an Ile, Trp, or Tyr residue.

46. The composition of matter of Embodiments 43-45, wherein the carboxy-terminal residue is amidated.

47. The composition of matter of Embodiment 43, comprising an amino acid sequence selected from SEQ ID NO:247, SEQ ID NO:296, SEQ ID NO:358, SEQ ID NO:360, SEQ ID NO:361, SEQ ID NO:363, SEQ ID NO:364, SEQ ID NO:365, SEQ ID NO:366, SEQ ID NO:367, SEQ ID NO:368, SEQ ID NO:369, SEQ ID NO:370, SEQ ID NO:372, SEQ ID NO:373, SEQ ID NO:374, SEQ ID NO:375, SEQ ID NO:376, SEQ ID NO:377, SEQ ID NO:378, SEQ ID NO:379, SEQ ID NO:380, SEQ ID NO:381, SEQ ID NO:382, SEQ ID NO:383, SEQ ID NO:384, SEQ ID NO:385, SEQ ID NO:386, SEQ ID NO:387, SEQ ID NO:388, SEQ ID NO:389, SEQ ID NO:390, SEQ ID NO:391, SEQ ID NO:398, SEQ ID NO:399, SEQ ID NO:400, SEQ ID NO:401, SEQ ID NO:402, SEQ ID NO:403, SEQ ID NO:404, SEQ ID NO:405, SEQ ID NO:410, SEQ ID NO:423, SEQ ID NO:424, SEQ ID NO:425, SEQ ID NO:427, SEQ ID NO:431, SEQ ID NO:432, SEQ ID NO:433, SEQ ID NO:434, SEQ ID NO:438, SEQ ID NO:446, SEQ ID NO:453, SEQ ID NO:454, SEQ ID NO:571, SEQ ID NO:579, SEQ ID NO:580, SEQ ID NO:581, SEQ ID NO:582, SEQ ID NO:583, SEQ ID NO:584, SEQ ID NO:585, SEQ ID NO:586, SEQ ID NO:587, and SEQ ID NO:588.

48. The composition of matter of any of Embodiments 1-47, further comprising an optional linker moiety and a pharmaceutically acceptable, covalently linked half-life extending moiety.

49. The composition of matter of Embodiment 48, wherein the optional linker moiety is covalently linked at:

(a) the N-terminal residue;

(b) the C-terminal residue; or (c) $X_{aa}^{2}$, $X_{aa}^{3}$, $X_{aa}^{13}$, $X_{aa}^{16}$, or $X_{aa}^{19}$.

50. The composition of matter of Embodiments 48-49, wherein the optional linker moiety is a multivalent linker.

51. The composition of matter of Embodiments 48-50, wherein the half-life extending moiety is polyethylene glycol of molecular weight of about 1000 Da to about 100000 Da, an IgG Fc domain, a transthyretin, a human serum albumin, or a lipid or albumin binding peptide.

52. The composition of matter of Embodiments 48-50, wherein the half-life extending moiety comprises a human immunoglobulin or a human immunoglobulin Fc domain, or both.

53. The composition of matter of Embodiment 52 having a configuration as set forth in any of FIG. 81A-C, FIG. 94A-N, FIG. 95, FIG. 96, FIG. 97, or FIG. 98.

54. The composition of matter of Embodiment 52, wherein the composition comprises a monovalent immunoglobulin-peptide or Fc-peptide conjugate.

55. The composition of matter of Embodiment 52, wherein the composition comprises a bivalent immunoglobulin-peptide or Fc-peptide conjugate.

56. The composition of matter of Embodiments 48-50, wherein the composition of matter comprises a human-serum albumin-peptide conjugate.

57. The composition of matter of Embodiments 48-50, wherein the composition of matter comprises a lipidated peptide or serum albumin binding peptide-peptide conjugate.

58. A pharmaceutical composition, comprising the composition of matter of any of Embodiments 1-57, and a pharmaceutically acceptable carrier.

59. A method of preventing pain, comprising administering a prophylactically effective amount of the composition of any of Embodiments 1-58.

60. A method of treating pain, comprising administering a therapeutically effective amount of the composition of any of Embodiments 1-58.

61. The method of Embodiment 60, wherein the pain is chronic pain, acute pain, or persistent pain.

62. The method of Embodiment 61, wherein the chronic pain is associated with cancer, chemotherapy, osteoarthritis, fibromyalgia, primary erythromelalgia, post-herpetic neuralgia, painful diabetic neuropathy, idiopathic painful neuropathy, neuromas, paroxysmal extreme pain disorder, migraine, trigeminal neuralgia, orofacial pain, cluster headaches, complex regional pain syndrome (CRPS), failed back surgery syndrome, sciatica, interstitial cystitis, pelvic pain, lower back pain, inflammation-induced pain, or joint pain.

63. The method of Embodiment 61, wherein the acute or persistent pain is associated with trauma, burn, or surgery.

64. An isolated nucleic acid encoding any of SEQ ID NO:63, SEQ ID NO:69, SEQ ID NO:112, SEQ ID NO:113, SEQ ID NO:115, SEQ ID NO:131, SEQ ID NO:137, SEQ ID NO:193, SEQ ID NO:194, SEQ ID NO:195, SEQ ID NO:196, SEQ ID NO:200, SEQ ID NO:201, SEQ ID NO:202, SEQ ID NO:203, SEQ ID NO:207, SEQ ID NO:208, SEQ ID NO:209, SEQ ID NO:210, SEQ ID NO:214, SEQ ID NO:215, SEQ ID NO:216, SEQ ID NO:217, SEQ ID NO:221, SEQ ID NO:222, SEQ ID NO:223, SEQ ID NO:224, SEQ ID NO:228, SEQ ID NO:229, SEQ ID NO:230, SEQ ID NO:231, SEQ ID NO:235, SEQ ID NO:236, SEQ ID NO:237, SEQ ID NO:238, SEQ ID NO:242, SEQ ID NO:243, SEQ ID NO:244, SEQ ID NO:245, SEQ ID NO:246, SEQ ID NO:277, or SEQ ID NO:279, that does not include a non-canonical amino acid.

65. An expression vector comprising the nucleic acid of Embodiment 64.

66. A recombinant host cell comprising the expression vector of Embodiment 65.

The following working examples are illustrative and not to be construed in any way as limiting the scope of the present invention.

EXAMPLES

Example 1: Isolation and Purification of JzTx-V (SEQ ID NO:2) from Venom

Venom Sample Preparation.

Venom from the tarantula *Chilobrachys jingzhao* was extracted via electrical stimulation of an anesthetized spider. Venom samples were collected, lyophilized, and dissolved in 0.1% trifluoroacetic acid (TFA) in water to approximately 1 mg venom/mL. The crude venom solutions were desalted by solid-phase extraction (SPE) with Sep-Pak C18 cartridges (Waters, Milford, Mass., USA) equilibrated in 0.1% TFA, and eluted with 60% aqueous acetonitrile and then evaporated. The dried material was dissolved in 0.1% TFA to 1 mg venom/mL concentration and higher molecular components removed with a 10 kDa molecular weight cut-off Ultrafree-CL (Millipore). The <10 kDa venom extract was then dried under in vacuo and stored at −80° C.

Fractionation.

The crude venom was fractionated by reversed phase (RP) HPLC, collecting 84 samples in time slices. Less than 10 kDa venom extracts were dissolved in 0.1% TFA to approximately 1 mg venom/mL, and then separated by C18 RP HPLC chromatography and collected into approximately 1 minute wide fractions. HPLC method: Buffer A (0.1% TFA in water) and buffer B (90% acetonitrile/10% water containing 0.1% TFA) at 1 mL/min with a 1%/min gradient 0-100% buffer B. The fractions were then transferred into a plate format, dried under in vacuo, and then stored at −80° C.

The venom fractions were screened for activity in the Nav1.7 IONWORKS® QUATTRO (IWQ) patch clamp system-based assays. Several fractions with significant (>50% of control) Nav1.7 inhibitory activity were identified. A second aliquot of the fractions was tested in the Nav1.7, Nav1.4, and Nav1.5 IWQ assays to confirm the activity of the "hit" and evaluate selectivity. The most potent and selective fractions were then separated by RP-HPLC, and the corresponding sub-fractions were screened for activity in the Nav1.7, Nav1.4, and Nav1.5 assays. Deconvolution of the most active sub-fraction revealed the primary peptide sequence of JzTx-V (SEQ ID NO:2). As with all proteins, JzTx-V is expected to have essentially zero access to the central nervous system.

JzTx-45 (YCQKWMWTCDSERKCCEGYVCELWCKYNL//SEQ ID NO:48) and JzTx-46 (YCQKWMWTCDSERKCCEGYVCELWCKYNM//SEQ ID NO:430) were identified through transcriptomic analysis of the venom gland of *Chilobrachys jingzhao* using expressed sequence tag methodologies. (See, Chen J, Deng M, He Q, Meng E, Jiang L, Liao Z, Rong M, Liang S, "Molecular diversity and evolution of cystine knot toxins of the tarantula *Chilobrachys jingzhao", Cellular and Molecular Life Sciences* 2008, 65:2431-2444; Siang A S, Doley R, Vonk F J, Kini R M., "Transcriptomic analysis of the venom gland of the red-headed krait (*Bungarus flaviceps*) using expressed sequence tags", *BMC Molecular Biology* 2010, 11:24; Jiang Y, Li Y, Lee W, Xu X, Zhang Y, Zhao R, Zhang Y, Wang W., "Venom gland transcriptomes of two elapid snakes (*Bungarus multicinctus* and *Naja atra*) and evolution of toxin genes", BMC Genomics 2011, 12:1; Wagstaff S C, Sanz L, Juárez P, Harrison R A, Calvete J J., "Combined snake venomics and venom gland transcriptomic analysis of the ocellated carpet viper, *Echis ocellatus.", J Proteomics.* 2009 71(6):609-23; Magalhaes G S, Junqueira-de-Azevedo I L, Lopes-Ferreira M, Lorenzini D M, Ho P L, Moura-da-Silva A M. "Transcriptome analysis of expressed sequence tags from the venom glands of the fish *Thalassophryne nattereri", Biochimie* 2006 88(6):693-9; Wagstaff S C, Harrison R A., Venom gland EST analysis of the saw-scaled viper, *Echis ocellatus*, reveals novel alpha9beta1 integrin-binding motifs in venom metalloproteinases and a new group of putative toxins, renin-like aspartic proteases." *Gene* 2006 377:21-32).

Peptide Sequencing: Edman Degradation and De Novo MS/MS.

N-terminal sequencing of peptides were performed by Edman degradation (Reference: (1) Edman, P. (1950), "Method for determination of the amino acid sequence in peptides", Acta Chem. Scand. 4: 283-293; (2) Niall, H. D. (1973). "Automated Edman degradation: the protein sequenator". Meth. Enzymol. 27: 942-1010). Phenylthiohydantoin (PTH)—amino acid derivatives were analyzed with an Applied Biosystems automatic 473A sequencer.

De novo peptide sequencing was accomplished by tandem mass spectrometry (References: Vlado Dančík, Theresa A. Addona, Karl R. Clauser, James E. Vath, Pavel A. Pevzner., J. Comp. Biol., Volume 6, 3/4, (1999); (2) Favreau, P., Menin, L., Michalet, S., Perret, F., Cheneval, Stöcklin, M., Bulet, A. and Stöcklin, R., Toxicon, 47(6), 676-687, (2006), (3) Favreau, P., Cheneval, O., Menin, L., Michalet, S., Gaertner, H., Principaud, F., Thai, R., Ménez, A., Bulet, P. and Stöcklin, R. (2007), The venom of the snake genus Atheris contains a new class of peptides with clusters of histidine and glycine residues. Rapid Communications in Mass Spectrometry, 21: 406-412).

Example 2: Synthesis of JzTx-V Peptide Analogs

Small-scale peptide synthesis. Peptides were assembled using $N^{\alpha}$-Fmoc solid-phase peptide synthesis methodologies with appropriate orthogonal protection and resin linker strategies. The peptides were synthesized on a 0.012 mmol scale using Rink Amide MBHA resin (100-200 mesh, 1% DVB, RFR-1063-PI, 0.52 meq/g initial loading, 408291, Peptides International, Louisville, Ky.). Dry resin (17 mg per well) was added to a Phenomenex deep well protein precipitation plate (CEO-7565, 38710-1) using a resin loader (Radley) Amino acids were added to the growing peptide chain by stepwise addition using standard solid phase methods on an automated peptide synthesizer (Intavis Multipep). Amino acids (5 molar equivalents, 120 μL, 0.5 M in DMF) were pre-activated (1 min) with (1-Cyano-2-ethoxy-2-oxoethylidenaminooxy)dimethylamino-morpholino-carbenium hexafluorophosphate (COMU®; 5 molar equivalents, 170 μL, 0.35 M in dimethylformamide (DMF)) and N,N-Diisopropylethylamine (DIEA; 7.5 molar equivalents, 70 μL, 1.25 M in dichloromethane (DCM)). Pre-activated amino acids were transferred to the appropriate well. Resins were incubated for 30 min, drained, and the cycle repeated. Following the $2^{nd}$ amino acid incubation the plates were drained and washed with DMF 8 times (3 mL per column of 8 wells). The Fmoc protecting groups were then removed by 2 sequential incubations in 500 μL of a 20% piperidine in DMF solution. The $1^{st}$ incubation was 5 min, the resin drained, and the $2^{nd}$ incubation was for 20 min. The resin was drained and washed with DMF 10 times (3 mL per column of 8 wells). After removal of the final Fmoc protecting group, the resin was washed with DCM 5 times (3 mL per column of 8 wells) and allowed to air dry.

Cleavage.

To the bottom of the filter plate was affixed a drain port sealing mat (ArcticWhite, AWSM-1003DP). To the resin in each well was added triisopropylsilane (100 μL), DODT (100 μL), and water (100 μL) using a multichannel pipette. To the resin in each well was added TFA (1 mL) using a Dispensette Organic dispenser. A second sealing mat was affixed to the top of the plate, and the solution was mixed for 3 h on a shaker. The sealing mats were removed from the top then the bottom, and the cleavage solution was eluted into a solid bottom 96-well deep well plate. The resin in each well was washed with and additional 1 mL of TFA. The solutions were concentrated using rotary evaporation (Genevac). To each well in a new 96-well filter plate with a bottom sealing mat attached was added 1 mL of cold diethyl ether using a Dispensette Organic dispenser. To the ether was added the concentrated peptide solutions using a multichannel pipette with wide bore tips. The solution was agitated with the pipette to ensure complete mixing and precipitation. The white solid was filtered, washed with a second 1 mL of cold ether, filtered, and dried under vacuum.

Folding.

To the crude peptide in each well was added 0.9 mL of 50:50 water/acetonitrile with a multichannel pipette and a micro stir bar. The mixture was stirred for 1 h. The solution was filtered into a solid bottom 96-well deep well plate. To the crude peptide in each well was added another 0.9 mL of 50:50 water/acetonitrile with a multichannel pipette. The solution was filtered into the same solid bottom 96-well deep well plate. In a 4 L bottle was prepared 4.0 L of folding buffer (3.3 L water, 300 mL acetonitrile, 2.0 g oxidized glutathione, 1.0 g reduced glutathione, 400 mL 1 M Tris-HCl pH 7.5). To 96 50-mL centrifuge tubes was added 40 mL of peptide folding buffer using a Dispensette dispenser. To the folding buffer was added the 1.8 mL of dissolved peptide using the Tecan automated liquid handler. The pH of the folding solutions was measured to about 7.7. The folding reactions were allowed to stand overnight. To each tube was added 1 mL of glacial acetic acid. To a 96-well filter plate was added SP Sepharose High Performance as a slurry (1 mL per well) with a multichannel pipette. Using the Tecan automated liquid handler, the gel was conditioned with folding buffer (3×0.9 mL), loaded with the folded peptide solution (50×0.9 mL, pH=4.0, on the Tecan automated liquid handler), washed (4×0.9 mL, 20 mM NaOAc, pH=4.0), and eluted manually on a vacuum manifold with 2×1 mL (1 M NaCl, 20 mM NaOAc, pH=4.0) into a solid bottom 96-well deep well plate.

Conjugation of Peptides to PEG.

Figure 76A:
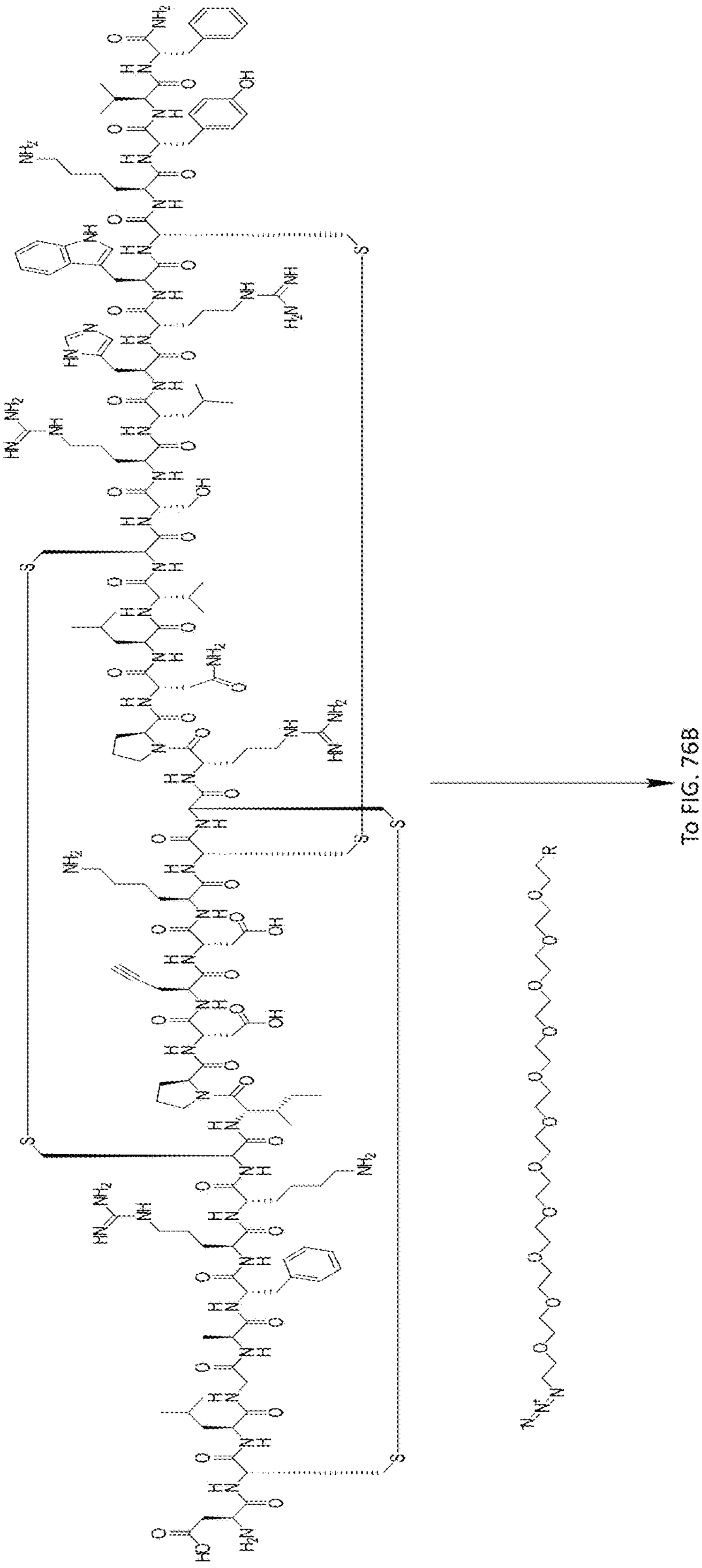
FIG. 76A-B shows a schematic representation of a copper-catalyzed 1,3-dipolar cycloaddition reaction between an azide-containing linker and an alkyne-containing peptide (FIG. 76A) to form a triazole linkage (FIG. 76B).
Figure 76B:
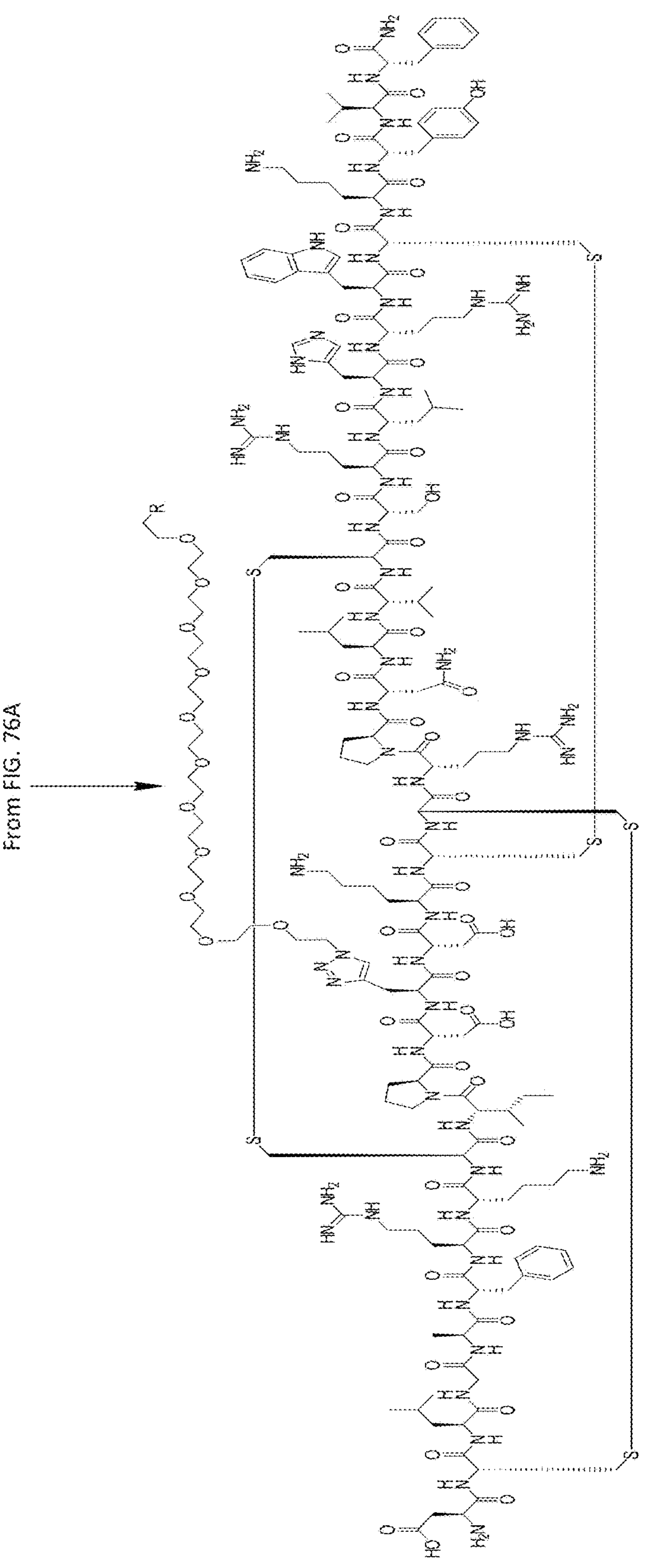

Some JzTx-V peptide analogs were conjugated to azido-NPEG10 (e.g., see, FIG. 76A-B, Table 9 and Table 13, below). To 1 mL of the folded peptide in the IEX elution buffer was added in order 32-azido-3,6,9,12,15,18,21,24,27,30-decaoxadotriacontan-1-amine (70 μL, 50 mM aq.), tris (2-phenyl-1-(1H-1,2,3-triazol-4-yl)ethyl)amine (TBTA; 88 μL, 10 mM in DMSO), L-ascorbic acid sodium salt (438 μL, 75 mM aq.), and copper (ii) sulfate, anhydrous, powder (188 μL, 35 mM aq.). The reaction mixture turned slightly cloudy after the addition of the TBTA. After overnight incubation, the plate was centrifuged for 1 h at 1600 rpm to pellet any precipitate. The supernatant was transferred to a 96-well filter plate with a multichannel pipette and filtered into a solid bottom 96-well plate.

Purification and Characterization of Molecules.

Figure 1:
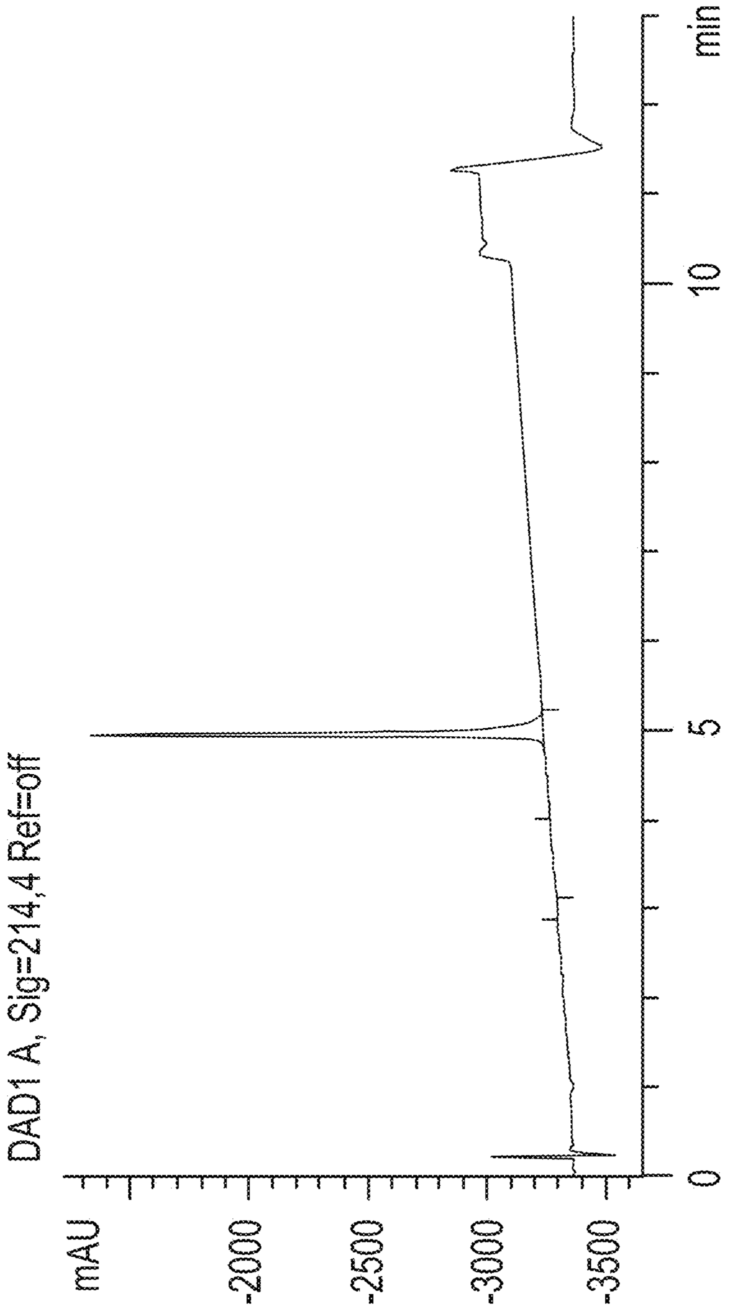
FIG. 1 shows the reversed phase (RP) HPLC chromatogram of UV absorbance at 214 nm from the LC-MS analysis of synthetic JzTx-V(1-29) (SEQ ID NO:2).

The folded (conjugated) peptide (2 mL) was purified by mass-triggered semi-prep HPLC (Agilent 1100/LEAP, Jupiter 5 μm C18 300 A, 100×10 mm 5 micron) with a gradient of 15-35% B over 45 min, with a 5 min flush, and 5 min equilibration at 8 mL/min. The collected fractions were pooled and reformatted into vials on the Tecan automated liquid handler. Final QC (Phenomenex Jupiter 20×2 mm, 100 Å, 5 micron column eluted with a 10 to 60% B over 10 min gradient at a 0.750 mL/min flow rate monitoring absorbance at 220 nm) and CLND quantification were performed. Peptides with >95% purity and correct (m/z) ratio were screened. (See FIG. 1, FIG. 2, and FIG. 3 for LC-MS characterization of synthetic JzTx-V).

In subsequent synthesis runs, the protocol was modified in order to improve the overall success rate of obtaining folded peptide analogs in sufficient purity for assay submission. Peptides were synthesized in duplicate, triplicate, or quadruplicate on the Intavis synthesizer. The crude linear peptide was combined, dissolved in DMSO, and purified immediately by prep LC/MS (Phenomenex Synergi 4 μm MAX-RP 80A AXIA, 250×30 mm) at 30 mL/min, Agilent/LEAP prep LC-MS, 10-40% B gradient over 60 min, followed by a 10 min flush and a 10 min equilibration). The fractions were analyzed by LC-MS, pooled, and lyophilized to afford pure linear peptide. The pure linear peptide was dissolved in 2 mL of acetonitrile and 2 mL of water and folded as described previously for the crude peptide. After quenching, the folded peptide solution was loaded directly onto a semi-prep HPLC column using a prep loading pump at 8 mL/min. The column was flushed with 10% acetonitrile in water with 0.1% trifluoroacetic acid (TFA) to remove the acetic acid and then attached to the semi-prep LC-MS and purified as described previously.

Medium-Scale Peptide Synthesis.

Rink Amide Chem Matrix resin (0.2 mmol, 0.45 mmol/g loading, 0.444 g, Matrix Innovation) was weighed into a CS BIO reaction vessel. The reaction vessel was connected to a channel of the CS BIO 336X automated peptide synthesizer, and the resin was washed 2×DMF and allowed to swell in DMF for 15 min. Fmoc-amino acid (1.0 mmol, Midwest Biotech or Novabiochem) was dissolved in 2.5 mL of 0.4 M 6-chloro-1-hydroxybenzotriazole (6-Cl-HOBt, Matrix Innovation) in DMF. To the solution was added 1.0 mL of 1.0 M 1,3-diisopropylcarbodiimide (DIC, Sigma-Aldrich) in DMF. The solution was agitated with nitrogen bubbling for 15 min to accomplish pre-activation and then added to the resin. The mixture was shaken for 2 h. The resin was filtered and washed 3×DMF, 2×DCM, and 3×DMF. Fmoc-removal was accomplished by treatment with 20% piperdine in DMF (5 mL, 2×15 min, Fluka). The resin was filtered and washed 3×DMF. All residues were single coupled through repetition of the Fmoc-amino acid coupling and Fmoc removal steps described above.

Cleavage and Linear Peptide Purification.

After final Fmoc-removal from the N-terminal residue, resin-bound linear peptide (0.2 mmol scale) was transferred to a 25 mL solid phase extraction (SPE) filter tube, washed 3×DMF and 3×DCM, and dried under vacuum. To the resin was added triisopropylsilane (1.0 mL), 3,6-dioxa-1,8-octane-dithiol (DODT, 1.0 mL), water (1.0 mL), trifluoroacetic acid (TFA, 15 mL), and a stir bar, and the mixture was stirred for 3 h. The mixture was filtered into a 50 mL centrifuge tube. The resin was washed with TFA (~5 mL), and the combined filtrate was concentrated by rotary evaporation in a Genevac HT-12 (30° C. chamber temperature, pressure ramp from 500 to 50 mbar over 40 min and a final pressure of 8 mbar for 2 h). To the residue (~5 mL) was added 40 mL cold diethyl ether. A white precipitate formed. The solid was stirred in the ether. The mixture was centrifuged (4 min, 4,400 rpm), and the ether was decanted. To the tube was added another 40 mL of cold ether, and the precipitate was stirred. The mixture was centrifuged, and the ether was decanted. The solid was dried overnight under vacuum. The crude linear peptide was purified by preparative LC-MS. The filtered sample (300 mg in 5 mL DMSO) was injected onto a preparative HPLC column (Phenomenex Synergi 4 μm MAX-RP 80A AXIA, 250×30 mm) The peptide was eluted with a 10-40% B over 60 min gradient at 30 mL/min, followed by a 10 min flush and a 10 min equilibration. The fractions were analyzed by LC-MS, pooled, and lyophilized to afford pure the linear peptide precursor.

Folding.

In a 1-L PP bottle was prepared a folding buffer with water (800 mL), acetonitrile (100 mL), cysteine (1 mL of a 1 M stock solution in water), and cystine dihydrochloride (6.667 mL of a 150 mM stock solution in water). To the pure linear peptide (100 mg) was added 5 mL acetonitrile and 5 mL water. The mixture was vortexed to complete dissolution of the peptide. The peptide solution was added to the buffer followed by 1M Tris-HCl pH 8.0 (100 mL), (0.1 mg/mL peptide concentration, 1 mM cysteine, 1 mM cystine, 10% v/v acetonitrile, 0.1 M Tris pH 8.0). The pH value was measured to be 8.0. The folding mixture was allowed to stand at 4° C. for 18 to 72 h. A small aliquot was removed and the sample was analyzed by LC-MS to ensure that the folding was complete. The solution was quenched by the addition of 4 mL AcOH and 4 mL TFA (pH=2.5). The aqueous solution was filtered (0.45 μM cellulose membrane).

Purification.

The filtered solution (1000 mL, 100 mg peptide) was loaded onto a preparative HPLC column (Phenomenex Synergi 4 μm MAX-RP 80A AXIA, 250×30 mm) at 30 mL/min using an Agilent preparative loading pump. The column was flushed for 10 min with 10% B at 30 mL/min to elute the AcOH/TFA. The column was attached to a prep HPLC, Agilent/LEAP prep LC-MS, and the peptide was eluted with a 10-40% B gradient over 60 min, followed by a 10 min flush and a 10 min equilibration. The fractions were analyzed by LC-MS, pooled, and lyophilized to afford pure folded peptide.

Large-Scale Peptide Synthesis.

Rink Amide MBHA resin (2.0 mmol, 0.52 mmol/g loading, 3.846 g, Peptides International) was weighed into a large CS BIO reaction vessel attached to one channel of the CS BIO 536, and the resin was washed 2×30 mL with DMF and allowed to swell in DMF for 15 min. Fmoc-amino acid (20 mmol, GL Biochem) was dissolved in 50 mL (total volume) of DMF (0.4 M). To 20 mL of the 0.4 M amino acid solution was added 20 mL of 0.4 M 6-Cl-HOBt (Matrix Innovation) and 10 mL of 0.8 M DIC (Sigma-Aldrich) in DMF. The solution was incubated for 10 min to accomplish pre-activation and then added to the resin. The mixture was stirred with nitrogen bubbling for 2 h. The resin was filtered and washed 5×30 mL of DMF. Fmoc-removal was accomplished by treatment with 20% piperdine in DMF (50 mL, 2×15 min, Fluka). The resin was filtered and washed 3×30 mL of DMF. Residues were single coupled through repetition of the Fmoc-amino acid coupling and Fmoc removal steps described above in a single run. Ile, Leu, and Gly residues were double coupled.

Cleavage.

The resin-bound linear peptide (2.0 mmol scale) was washed 3×50 mL of DMF and 3×50 mL of DCM, and dried under vacuum in a 500 mL fitted glass synthesis funnel. To the resin was added triisopropylsilane (10 mL), 3,6-dioxa-1,8-octane-dithiol (DODT, 10 mL), water (10 mL), and trifluoroacetic acid (TFA, 400 mL), and the mixture was allowed to stand for 1.5 h with occasional stirring. The mixture was filtered into a 5 L round bottom flask (plastic+glass). The resin was washed with TFA (3×100 mL), and the combined filtrate was concentrated by rotary evaporation on the RotaVap (temp=20° C., pressure=80 to 60 mbar over a 30-minute period). To the residue was 1 L of cold diethyl ether. A white precipitate formed. The solid was shaken in the ether. The mixture was filtered using a 600 mL C fritted glass funnel. To the solid was added 200 mL of cold ether, and the precipitate was stirred. The mixture was filtered. The solid was washed with an additional 200 mL of ether. The solid was scraped out of the funnel into a 1 L round bottom flask and dried under vacuum overnight to give 6.0 g of crude linear peptide. A small sample was removed for LC-MS analysis (5-50% B over 5 min).

Purification of Crude Linear Peptide.

A 0.1 M solution of TCEP in DMSO was prepared fresh for dissolution of the peptide. The solid peptide was crushed to a fine powder using a spatula. To the solid peptide (1000 mg) was added 0.1 M TCEP in DMSO (10 mL), and the mixture was vortexed for several minutes to complete dissolution. The solution was filtered using a syringe filter (0.45 micron, nylon) and injected immediately onto a large-scale prep HPLC column (Phenomenex Jupiter C18 10 μm 300A, 100×50 mm, Varian hardware) and eluted with a gradient of 15-45% B over 90 minutes with a 10 minute flush and 35 minute equilibration at a flow rate of 80 mL/min on an Agilent 1200 prep HPLC. This process was repeated 5 more times, injecting 1.0 g of peptide dissolved in 10 mL of DMSO solution each time. The fractions were analyzed by LC-MS and pooled to afford linear peptide in ~90% purity.

Folding.

A 15% yield from the crude linear purification (150 mg pure from 1000 mg crude) was assumed, and the peptide was folded at ~0.3 mg/mL. The good pool of purified linear peptide from above (170 mL of ~30% acetonitrile in water) was diluted to 510 mL (final volume) of folding buffer containing water, cysteine (1 mM), and cystine (1 mM) to give appropriate concentrations of acetonitrile (10% v/v final concentration) and peptide (0.3 mg/mL). To the peptide solution was added 1.0 M Tris-HCl, pH 8.0, 50 mL, to give a final volume of 560 mL. The pH value was measured to be 8.0. The folding mixture was shaken gently at 4° C. for 36 h. A small aliquot was removed and the sample was analyzed by LC-MS. Refolding was judged to be complete. TFA was added (~1.6 mL) to lower the pH of the solution to <2.5. The quenched peptide solution was filtered (0.45 micron cellulose membrane) and purified by prep RP-HPLC.

Purification.

The filtered solution of folded peptide, 560 mL, was loaded onto a prep HPLC column (Phenomenex Synergi 4 μm MAX-RP 80A, AXIA, 250×30 mm) at 40 mL/min using an Agilent prep loading pump. The column was then flushed for 10 min with 10% B at 30 mL/min to elute the TFA. The column was attached to a prep LC-MS, Agilent 1100/LEAP prep LC-MS, and eluted with a gradient of 15-35% B over 45 minutes with a 5 minute flush and 10 minute equilibration at a flow rate of 30 mL/min. The fractions were analyzed by LC-MS, pooled, and lyophilized to afford dry peptide. The process was repeated with the remaining folded peptide solution. Expected overall yield was 300 mg dry weight.

Counterion Exchange for Peptide In Vivo Studies.

A 4 mL SPE tube containing VariPure IPE (Varian, PL-HCO3 MP-Resin, polymer-supported hydrogencarbonate, 1.8 mmol/g, 100A, 150-300 μm) was pre-conditioned with 2 mL of MeOH, followed by 2 mL of water, draining by gravity. 2.0 mL of a ≤5.0 mM solution of purified folded peptide in water was applied to the bed. The device was washed with 4×2.0 mL of water to elute all of the peptide. To the eluent was added 50 μL of acetic acid. The solution was concentrated by rotary evaporation (Genevac) to afford the acetate salt of the purified folded peptide. A 100 mM stock solution of trifluoroethanol (TFE) in deuterium oxide (D2O) was prepared fresh by weighing 50 mg of TFE into a 5 mL volumetric flask, followed by addition of D2O to a final volume of 5 mL. A 5 mM solution of TFE in D2O was then prepared by dilution for dissolving all samples for 19F-NMR. The solution was used to dissolve peptide to a concentration of 1 mM, and the sample was analyzed by 19F-NMR using a fluorine long delay (dl=5 sec) method. The TFE integral (triplet at −76.75 ppm) was normalized to 5 and the integral of TFA (singlet at −75.6) recorded. NMR tube was cut, and sample was recovered by rotary evaporation (Genevac).

Example 3: Electrophysiology

Cell Lines Expressing Nav Channels.

Stable cell lines constitutively expressing human (h), mouse (m), or rat (r) voltage-gated sodium (Nav) channels (CHO-hNav1.3, HEK293-hNav1.4, HEK293-hNav1.5, HEK293-hNav1.6, HEK293-mNav1.7, HEK293T-rNav1.7, and HEK293-hNav1.7) or CHO cells expressing hNav1.8 under an inducible promoter were used for experiments.

Population patch clamp electrophysiology using IONWORKS® QUATTRO patch clamp system. Adherent cells were isolated from tissue culture flasks using 0.25% trypsin-EDTA treatment for 10 minutes and were resuspended in external solution consisting of 140 mM NaCl, 5.0 mM KCl, 10 mM HEPES, 2 mM $CaCl_2$, 1 mM $MgCl_2$, 10 mM Glucose, pH 7.4. Internal solution consisted of 70 mM KCl, 70 mM KF, 10 HEPES, 5 mM EDTA, pH 7.3. Cells were voltage clamped, using the perforated patch clamp configuration at room temperature (~22° C.), to −110 mV and depolarized to −10 mV before and 5 min after test compound addition. Compound dilutions contained 0.1% bovine serum albumin to minimize non-specific binding. Peak inward currents were measured from different cells for each compound concentration and $IC_{50}$ values were calculated with Excel software. All compounds were tested in duplicate (n=2).

Electrophysiology using PATCHXPRESS® 7000A patch clamp system. Adherent cells were isolated from tissue culture flasks using 1:10 diluted 0.25% trypsin-EDTA treatment for 2-3 minutes and then were incubated in complete culture medium containing 10% fetal bovine serum for at least 15 minutes prior to resuspension in external solution consisting of 70 mM NaCl, 140 mM D-Mannitol, 10 mM HEPES, 2 mM $CaCl_2$, 1 mM $MgCl_2$, pH 7.4 with NaOH. Internal solution consisted of 62.5 mM CsCl, 75 mM CsF, 10 HEPES, 5 mM EGTA, 2.5 mM $MgCl_2$, pH 7.25 with CsOH. Cells were voltage clamped using the whole cell patch clamp configuration at room temperature (~22° C.) at a holding potential of −125 mV with test potentials to −10 mV (hNav1.3, hNav1.4, hNav1.6, mNav1.7, rNav1.7, and hNav1.7) or −20 mV (hNav1.5). To record from partially inactivated channels, cells were switched to a voltage that yielded ~20% channel inactivation. Test compounds were added and Nay currents were monitored at 0.1 Hz at the appropriate test potential. All compound dilutions contained 0.1% bovine serum albumin to minimize non-specific binding. Cells were used for additional compound testing if currents recovered to >80% of starting values following compound washout. $IC_{50}$ values were calculated by pooling single point determinations at different compound concentrations and fitting the resulting dataset with a Hill (4-parameter logistic) fit in DataXpress 2.0 software.

Whole Cell Patch Clamp Electrophysiology.

Cells were voltage clamped using the whole cell patch clamp configuration at room temperature (~22° C.). Pipette resistances were between 1.5 and 2.0 MΩ. Whole cell capacitance and series resistance were uncompensated. Currents were digitized at 50 kHz and filtered (4-pole Bessel) at 10 kHz using pClamp 10.2. Cells were lifted off the culture dish and positioned directly in front of a micropipette connected to a solution exchange manifold for compound perfusion. To record from non-inactivated channels, cells were held at −140 mV or −120 mV and depolarized to −10 mV or 0 mV. To record from partially inactivated channels, cells were held at −140 mV or −120 mV initially and then switched to a voltage that yielded ~20% channel inactivation. 10 ms pulses were delivered every 10 seconds and peak inward currents were recorded before and after compound addition. Compound dilutions contained 0.1% bovine serum albumin to minimize non-specific binding. For hNav1.8 channel recordings, tetrodotoxin (TTX, 0.5 μM) was added to inhibit endogenous TTX-sensitive voltage-gated sodium channels and record only Nav1.8-mediated TTX-resistant currents. External solution consisted of: 140 mM NaCl, 5.0 mM KCl, 2.0 mM $CaCl_2$, 1.0 mM $MgCl_2$, 10 mM HEPES, and 11 mM Glucose, pH 7.4 by NaOH. Internal solution consisted of: 62.5 mM CsCl, 75 mM CsF, 2.5 mM $MgCl_2$, 5 mM EGTA, and 10 mM HEPES, pH 7.25 by CsOH. Escalating compound concentrations were analyzed on the same cell and $IC_{50}$ values were calculated with Clampfit 10.2 software and by fitting the resulting dataset with a Hill (4-parameter logistic) fit in Origin Pro 8 software.

DRG Neuron Isolation.

Adult male and female C57BL/6 mice (Harlan Laboratories and Charles River) and adult male Sprague Dawley rats (Charles River) were euthanized with sodium pentobarbital (Nembutal, 80 mg/kg, i.p., Western Med Supply, Arcadia, Calif.) or carbon dioxide asphyxiation followed by decapitation. DRG from cervical, thoracic and lumbar regions were removed, placed in $Ca^{2+}$ and $Mg^{2+}$-free Hanks' Balanced Salt Solution (Invitrogen, Carlsbad, Calif.), and trimmed of attached fibers under a dissecting microscope. DRG were sequentially digested at 37° C. with papain (20 U/ml, Worthington Biochemical Corporation, Lakewood, N.J.) and L-cysteine (25 μM) in $Ca^{2+}$ and $Mg^{2+}$-free Hanks' (pH 7.4) for 20-30 min and then with collagenase type 2 (0.9% w/v, Worthington Biochemical Corporation) for 20-30 min. Digestions were quenched with a 1:1 mixture of DMEM and Ham's F-12 Nutrient Mixture (Invitrogen) supplemented with 10% calf serum (Invitrogen), and cells were triturated with a fire-polished Pasteur pipette prior to plating on Poly-D-Lysine-coated glass coverslips (Cole-Parmer, Vernon Hills, Ill.). Cells were used for recordings following 1-2 hours of recovery (acute isolation) or maintained in a humidified incubator at 28° C. with 5% $CO_2$ for up to 10 days in the presence of 1% NSF-1 (Lonza, Basel, Switzerland) or B-27 supplement (Life Technologies) to increase the expression of tetrodotoxin-sensitive sodium channel currents.

Manual Patch-Clamp Electrophysiology for DRG Neurons.

DRG neurons were voltage clamped using the whole-cell patch clamp configuration at room temperature (21-24° C.) using an Axopatch 200 B or MultiClamp 700 B amplifier and DIGIDATA 1322A with pCLAMP software (Molecular Devices, Sunnyvale, Calif.). Pipettes, pulled from borosilicate glass capillaries (World Precision Instruments, Sarasota, Fla.), had resistances between 1.0 and 3.0 MΩ. Voltage errors were minimized using >80% series resistance compensation. A P/4 protocol was used for leak subtraction. Currents were digitized at 50 kHz and filtered (4-pole Bessel) at 10 kHz. Cells were lifted off the culture dish and positioned directly in front of a micropipette connected to a solution exchange manifold for compound perfusion. Cells were held at −120 mV or a voltage yielding approximately 20% inactivation and depolarized to −10 or 0 mV for 40 msec every 10 seconds. Tetrodotoxin (TTX, Sigma) was used following peptide addition to block any residual TTX-sensitive sodium currents. Pipette solution contained (in mM): 62.5 CsCl, 75 CsF, 2.5 $MgCl_2$, 5 EGTA, and 10 HEPES, pH 7.25 by CsOH. Bath solution contained (in mM): 70 NaCl, 5.0 KCl, 2.0 $CaCl_2$, 1.0 $MgCl_2$, 10 HEPES, and 11 glucose, 140 mannitol, pH 7.4 by NaOH. Data were analyzed with Clampfit and Origin Pro8 (OriginLab Corp, Northampton, Mass.).

Results of Electrophysiology Studies and Structure-Activity Relationship.

Results of electrophysiology studies are shown in Table 6, Table 7, Table 8, Table 9, Table 10 (IWQ), Table 11, Table 12, Table 13 (PX), Table 14 (WCPC), Table 15, and Table 16 (PX) below. Extensive systematic analoging using high-throughput peptide synthesis, parallel oxidative folding, and mass-triggered semi-prep HPLC purification for peptide analog preparation has given considerable insight into how individual positions within JzTx-V(1-29) (SEQ ID NO:2) contribute to its overall VGSC activity profile. Concerning the overall molecular framework, the disulfide bonds (or diselenide bonds) between Cys2 (or SeCys2) and Cys16 (or SeCys16) (C1-C4), between Cys9 (or SeCys9) and Cys21 (or SeCys21) (C2-C5) and between Cys15 (or SeCys15) and Cys25 (or SeCys25) (C3-C6) are essential for full function.

The N-terminal portion of JzTx-V(1-29) (SEQ ID NO:2), including residues Tyr1, Gln3, and Lys4, is amenable to modification without affecting either VGSC potency or selectivity in comparison with wild type JzTx-V. (See Table 6). Extension of the polypeptide chain by coupling an additional amino acid or acids to the N-terminus is well-tolerated and even improves the potency of the peptide against hNav1.7. (See Table 10). A set of N-terminally extended [Nle6]JzTx-V peptide analogs was prepared and tested in the hNav1.7, hNav1.4, and hNav1.5 PX assays. (See Table 11). Several peptides containing a hydrophobic residue at the N-terminus had improved potency against hNav1.7. They also had improved selectivities against hNav1.4 and hNav1.5 due to their increased hNav1.7 activity. Pra-[Nle6]JzTx-V(1-29) (SEQ ID NO:425) is nearly 200-fold more potent than the wild type JzTx-V(1-29) (SEQ ID NO:2) against hNav1.7 in the WCPC format with $IC_{50}$ values of 0.845 pM and 162 pM, respectively. (See Table 14). Tyr1 of JzTx-V can be substituted with a variety of amino acids with no impact on potency at $Na_V1.7$ or selectivity against $Na_V1.4$ and $Na_V1.5$. (See Table 6). [Glu1] JzTx-V(1-29) (SEQ ID NO:49) may have slightly increased potency against hNav1.7 with an accompanying small increase in selectivity against hNav1.4 and hNav1.5 in the PX assay format. (See Table 11). Gln3 and Lys4 in JzTx-V may be individually replaced with a basic amino acid such as arginine and still retain potency against $Na_V1.7$. (See Table 6).

Hydrophobic residues at positions 5, 6, and 7 (Trp5, Met6, and Trp7 in JzTx-V), in relation to SEQ ID NO:2, are essential to $Na_V1.7$ inhibitory potency. Only [1-Nal7] JzTx-V (SEQ ID NO:30) retained hNav1.7 activity similar to the wild type peptide. (See Table 6 and Table 11). Substitution of homophenylalanine at position 5 as in Pra-[hPhe5; Nle6; Glu28]JzTx-V(1-29) (SEQ ID NO:844) was found to increase hNav1.7 activity. (See Table 12). A variety of hydrophobic residues including norleucine, leucine and phenylalanine can be incorporated at position 6 to maintain good potency against Nav1.7 and selectivity against Nav1.4 in the PX assay format without the potential liability of oxidation by the native methionine residue. (See Table 10, Table 11, and Table 12).

While each position has recognizable preferences, the sequence of amino acids from Thr8 to Lys22 is quite tolerant of individual substitutions, with possible exceptions for the cysteines (SeCys substitutions permitted), Asp10, and Leu19 relative to SEQ ID NO:2. (See Table 6). Peptides synthesized without an aspartic acid residue at position 10 of JzTx-V have not been isolated in sufficiently pure form for screening, indicating this residue may be critical for proper folding of the peptide. Examples of peptides containing alanine, lysine, arginine, or glutamic acid at position 19 of JzTx-V had greatly reduced activity against hNav1.7. (See Table 12). Basic or neutral hydrophilic amino acids are acceptable as substitutions for Thr8 and Ser11, relative to SEQ ID NO:2, to maintain $Na_V1.7$ inhibitory potency. (See Table 6). Substitution of glutamic acid for Ser11 in combination with Glu28 also maintains potency against hNav1.7 in the PX assay. (See Table 12). Incorporation of propargylglycine at position 11 may increase Nav1.7 potency as observed with CyA-[Nle6; Pra11; Glu28]JzTx-V(1-29) (SEQ ID NO:520). (See Table 12). Arg13 appears to be the most sensitive residue in this portion of the sequence as substitution with either alanine or lysine caused a significant loss in potency. Lys12, Ala14, and Glu17, relative to SEQ ID NO:2, can be substituted with a variety of amino acids including attachment of a large PEG moiety with little effect on potency against $Na_V1.7$. (See Table 6, Table 9, Table 12, and Table 13). The combination of Glu12 or Glu14 substitutions with Glu28 resulted in JzTx-V analogs, such as Pra-[Nle6; Glu12,28]JzTx-V(1-29) (SEQ ID NO:715) and Pra-[Nle6; Glu14,28]JzTx-V(1-29) (SEQ ID NO:717), with potent Nav1.7 inhibitory activity and increased selectivity against Nav1.4. (See Table 12). Incorporation of a lysine residue at position 17 relative to SEQ ID NO:2 improved the yield of the oxidative folding reaction of the linear peptide to form the final disulfide-bonded product. Gly18 is somewhat sensitive to substitution as even incorporation of alanine at this position resulted in a slight loss of Nav1.7 potency. (See Table 6). Substitution of an acidic residue for arginine at position 20 relative to SEQ ID NO:2 greatly improves selectivity against hNav1.4 to greater than 1000-fold relative to hNav1.7, i.e., [Glu20]JzTx-V (SEQ ID NO:63) has an IC50 value of 1.25 μM against hNav1.4 in the PX assay format compared to an average IC50 value of 2 nM for JzTx-V(1-29) (SEQ ID NO:2). (See Table 6 and Table 11). The replacement of Arg20 with the charge-neutral citrulline also retains Nav1.7 activity as demonstrated by Pra-[Nle6; Cit20,26; Glu28]JzTx-V(1-29) (SEQ ID NO:799). (See Table 12). Lys22 of JzTx-V (SEQ ID NO:2), may be substituted with a basic amino acid and retain full Nav1.7 inhibitory potency. (See Table 6).

The C-terminal portion of the JzTx-V sequence is critical for the activity of the peptide against $Na_V1.7$. The leucine at position 23 of JzTx-V (SEQ ID NO:2) appears to be very important to obtaining high levels of potency against $Na_V1.7$, but is may be substituted with aliphatic hydrophobic residues like isoleucine, norleucine, or norvaline with retention of potency. (See Table 12). Incorporation of cyclohexylglycine as in Pra-[Nle6; Chg23,Glu28]JzTx-V (SEQ ID NO:859) may increase potency against hNav1.7. (See Table 12). The tryptophan residue at position 24 of JzTx-V (SEQ ID NO:2) is also very important for retaining potency against Nav1.7. An analog with a large hydrophobic substitution, [1-Nal24]JzTx-V(1-29) (SEQ ID NO:43), loses considerable activity against hNav1.7, but substitution on the indole ring is tolerated and improves Nav1.7 inhibitory potency, as demonstrated by Pra-[Nle6; 5-BrW24; Glu28] JzTx-V(1-29) (SEQ ID NO:858). (See Table 6, Table 11, and Table 12). Substitution of the arginine residue at position 26 of JzTx-V with glutamic acid, [Glu26]JzTx-V(1-29) (SEQ ID NO:67), greatly decreases the Nav1.7 inhibitory activity, but the neutral hydrophilic residue citrulline is tolerated as described above. (See Table 11 and Table 12). Lys27, relative to SEQ ID NO:2, may be substituted with a basic residue and retain Nav1.7 inhibitory potency. (See Table 6). The isoleucine at position 28 of JzTx-V (SEQ ID NO:2) can be substituted with a variety of amino acid residues with retention of potency against $Na_V1.7$, but the substitution of glutamic acid at this position increases selectivity by reducing activity against $Na_V1.4$. (See Table 6, Table 11, and Table 12). The Glu28 substitution to improve Nav1.4 selectivity is effective in combination with a large number of other amino acid substitutions at other positions in the JzTx-V scaffold. The isoleucine at position 29 of JzTx-V(1-29) (SEQ ID NO:2) can be substituted with other hydrophobic amino acids without losing potency against $Na_V1.7$. (See Table 6 and Table 12). Incorporating a phenylalanine at position 29 may increase Nav1.7 potency as demonstrated by Pra-[Nle6; Glu28; Phe29]JzTx-V(1-29). (See Table 12). The combination analog [Glu20,Trp29]JzTx-V(1-29) (SEQ ID NO:112) retains the excellent Nav1.4 selectivity (>1000-fold) characteristic of the substitution of glutamic acid at position 20 but has hNav1.7 potency similar to wild type JzTx-V with an average hNav1.7 IC50 value of 1.5 nM in the PX format. (See Table 7 and Table 11). Additional analogs of JzTx-V (1-29) (SEQ ID NO:2) that combine individual substitutions have demonstrated further improvements in selectivity against $Na_V1.4$ and $Na_V1.5$ and potency toward Nav1.7, i.e., [Glu20,Tyr28]JzTx-V(1-29) (SEQ ID NO:137) and [Glu20, Ser28]JzTx-V(1-29) (SEQ ID NO:138). (See Table 7, Table 8, and Table 11). The C-terminus of JzTx-V can be extended and/or prepared as the free acid with only a slight loss in potency, as demonstrated by JzTx-V(1-29)-FreeAcid (SEQ ID NO:1) and Pra-[Nle6; Glu28]JzTx-V(1-29)-Gly-Free Acid (SEQ ID NO:828).

Figure 4:
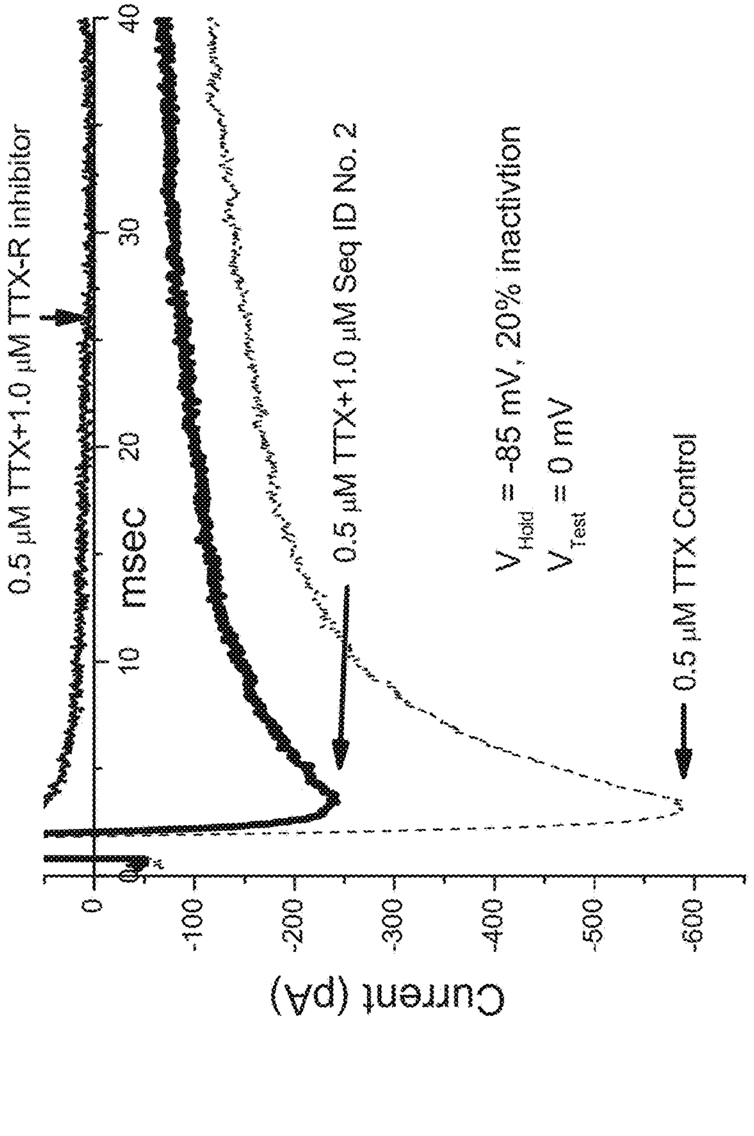
FIG. 4 shows the effect of JzTx-V(1-29) (SEQ ID NO:2) on hNav1.8 channels in inducible CHO cell. Cell was held at −85 mV and peak inward Nav currents were measured at 0 mV. "0.5 μM TTX Control" trace shows Nav current before JzTx-V(1-29) (SEQ ID NO:2), "0.5 μM TTX+1.0 μM Seq ID No. 2" trace shows Nav current after JzTx-V(1-29) (SEQ ID NO:2) addition, and "0.5 μM TTX+1.0 μM TTX-R inhibitor" shows Nav current after addition of a blocker of Nav1.8 channels that are resistant to block by TTX. Note that 0.5 μM JzTx-V(1-29) (SEQ ID NO:2) blocked approximately 50% of TTX-resistant hNav1.8 current. All solutions contained 0.5 μM TTX to block endogenous TTX-sensitive Nav currents.
Figure 7:
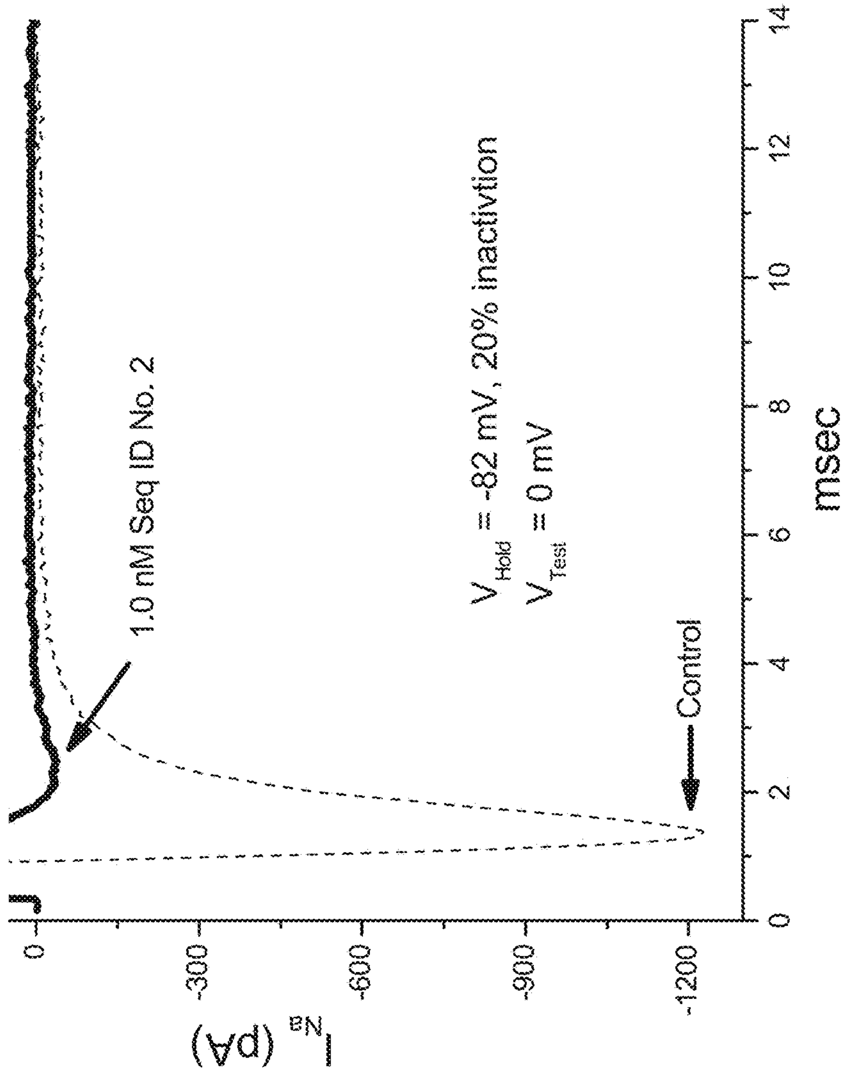
FIG. 7 shows the effect of JzTx-V(1-29) (SEQ ID NO:2) on hNav1.7 channels in HEK293 cell. Cell was held at −82 mV and peak inward Nav currents were measured at 0 mV. "Control" trace shows Nav1.7 current before JzTx-V(1-29) (SEQ ID NO:2), "1 μM Seq ID No. 2" trace shows Nav current after JzTx-V(1-29) (SEQ ID NO:2) addition.
Figure 8:
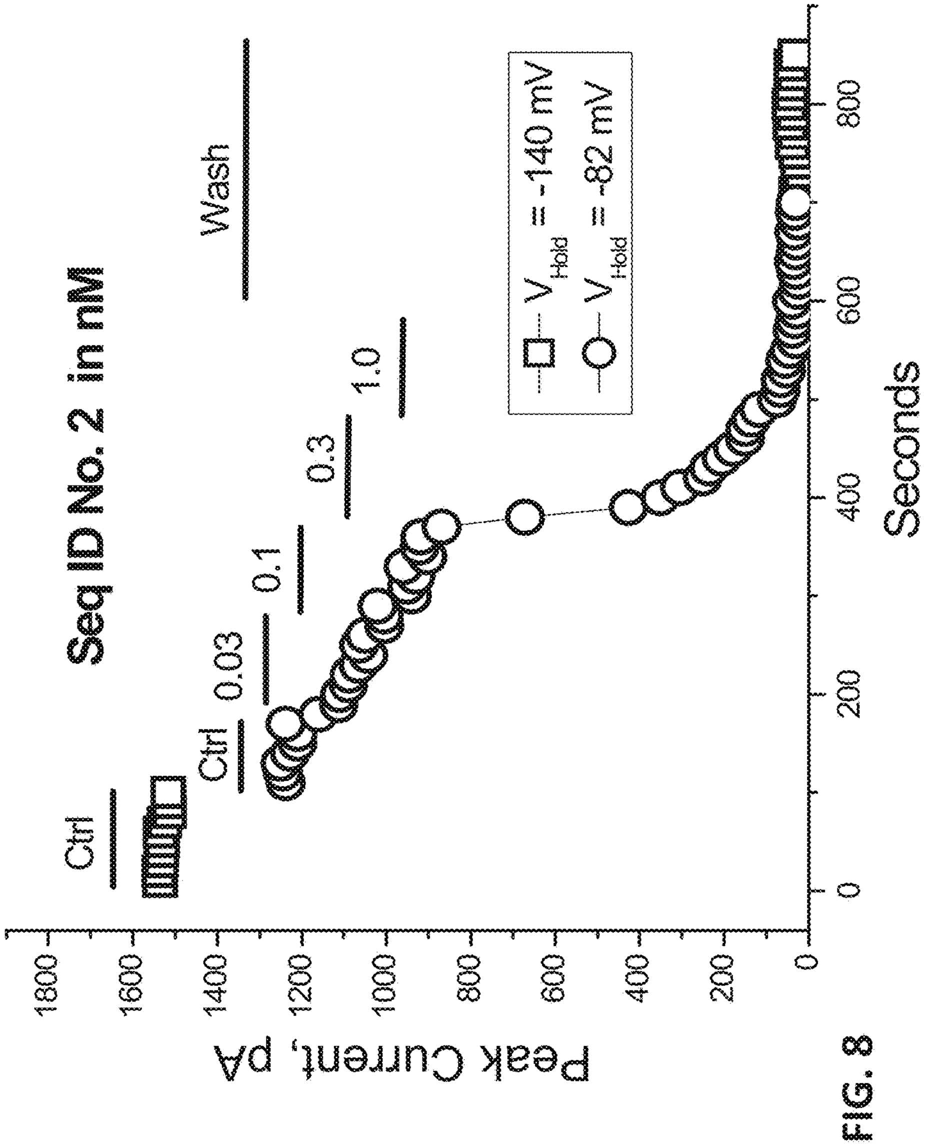
FIG. 8 shows the time course of increasing concentrations of JzTx-V(1-29) (SEQ ID NO:2) against hNav1.7 channels in HEK293 cell. Peak inward Nav currents were measured at 0 mV every 10 seconds in the presence of increasing concentrations of JzTx-V(1-29) (SEQ ID NO:2); cell was held at either −140 mV (squares), a voltage where Nav1.7 channels are completely non-inactivated, or −82 mV (circles), a voltage that yields approximately 20% inactivation. "Ctrl" indicates Nav1.7 current in the absence of JzTx-V(1-29) (SEQ ID NO:2) and "Wash" indicates Nav1.7 current following removal of JzTx-V(1-29) (SEQ ID NO:2). Note that 1 μM JzTx-V(1-29) (SEQ ID NO:2) blocked all Nav1.7 current.
Figure 9:
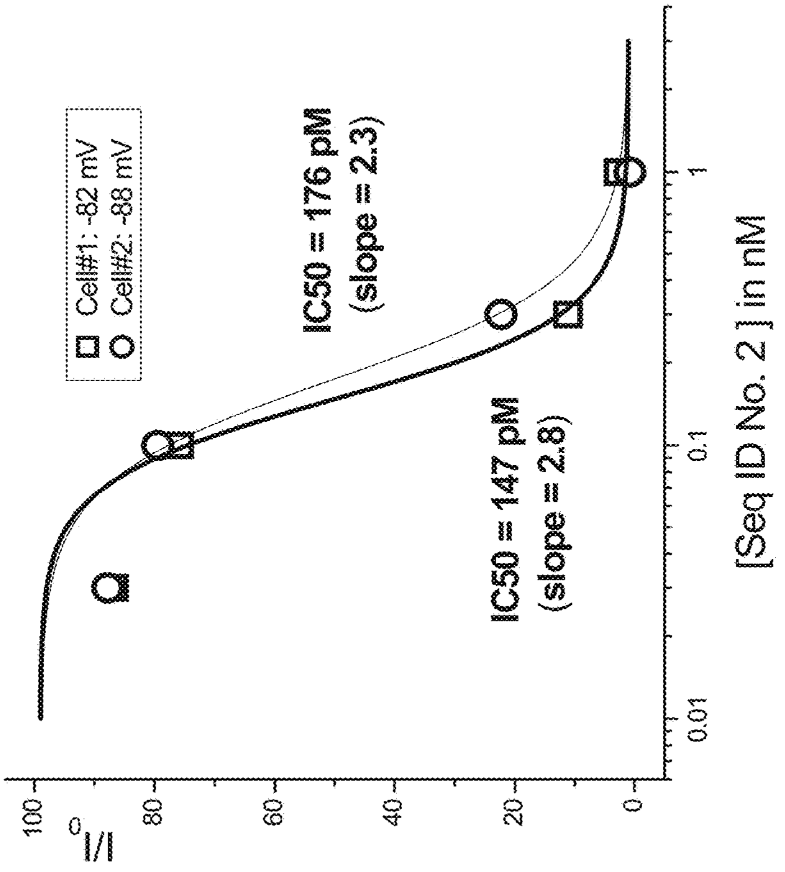
FIG. 9 shows the dose-response curves of JzTx-V(1-29) (SEQ ID NO:2) against hNav1.7 channels in two separate HEK293 cells. Peak inward Nav1.7 currents were measured at 0 mV in the presence of increasing concentrations of JzTx-V(1-29) (SEQ ID NO:2); cells were held at a voltage that yielded 20% inactivation.
Figure 10:
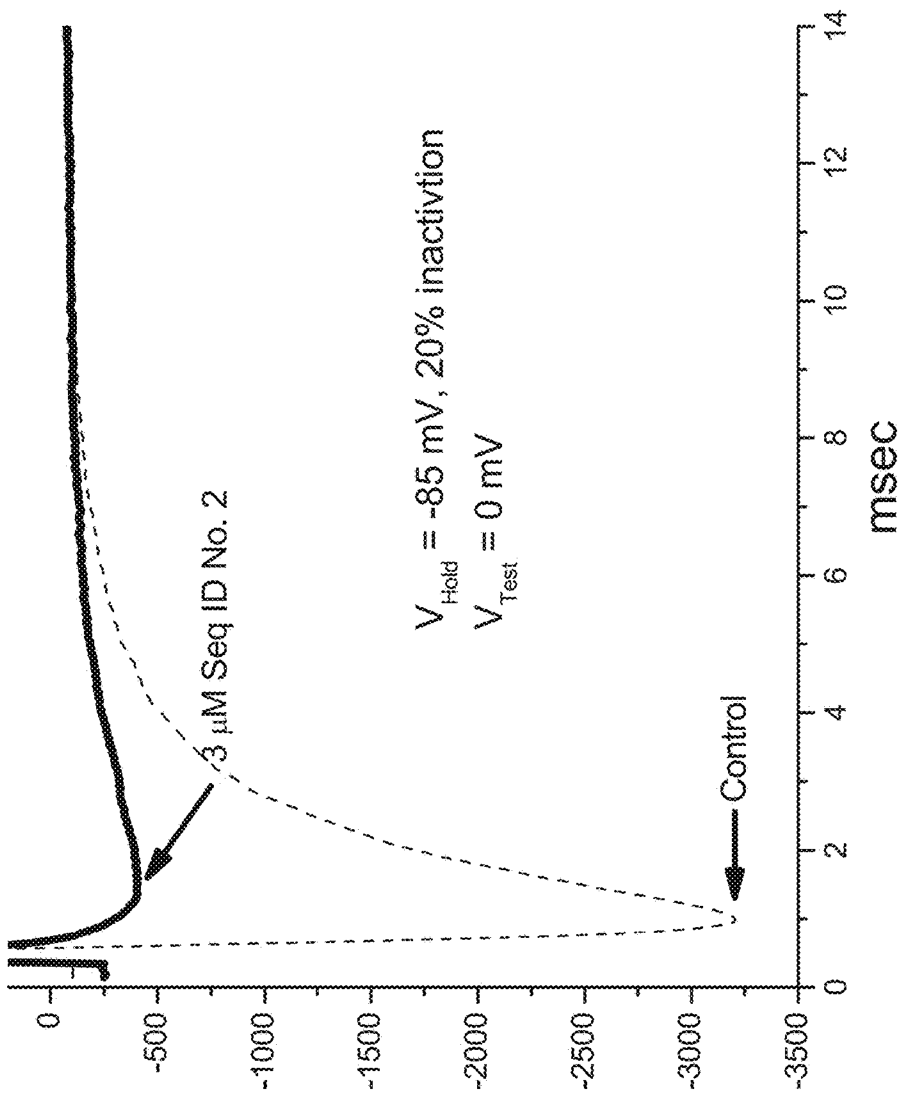
FIG. 10 shows the effect of JzTx-V(1-29) (SEQ ID NO:2) on hNav1.5 channels in HEK293 cell. Cell was held at −85 mV and peak inward Nav currents were measured at 0 mV. "Control" trace shows Nav1.5 current before JzTx-V(1-29) (SEQ ID NO:2), "3 μM Seq ID No. 2" trace shows Nav current after JzTx-V(1-29) (SEQ ID NO:2) addition. Note that 3 μM JzTx-V(1-29) (SEQ ID NO:2) blocked most Nav1.5 current.
Figure 11:
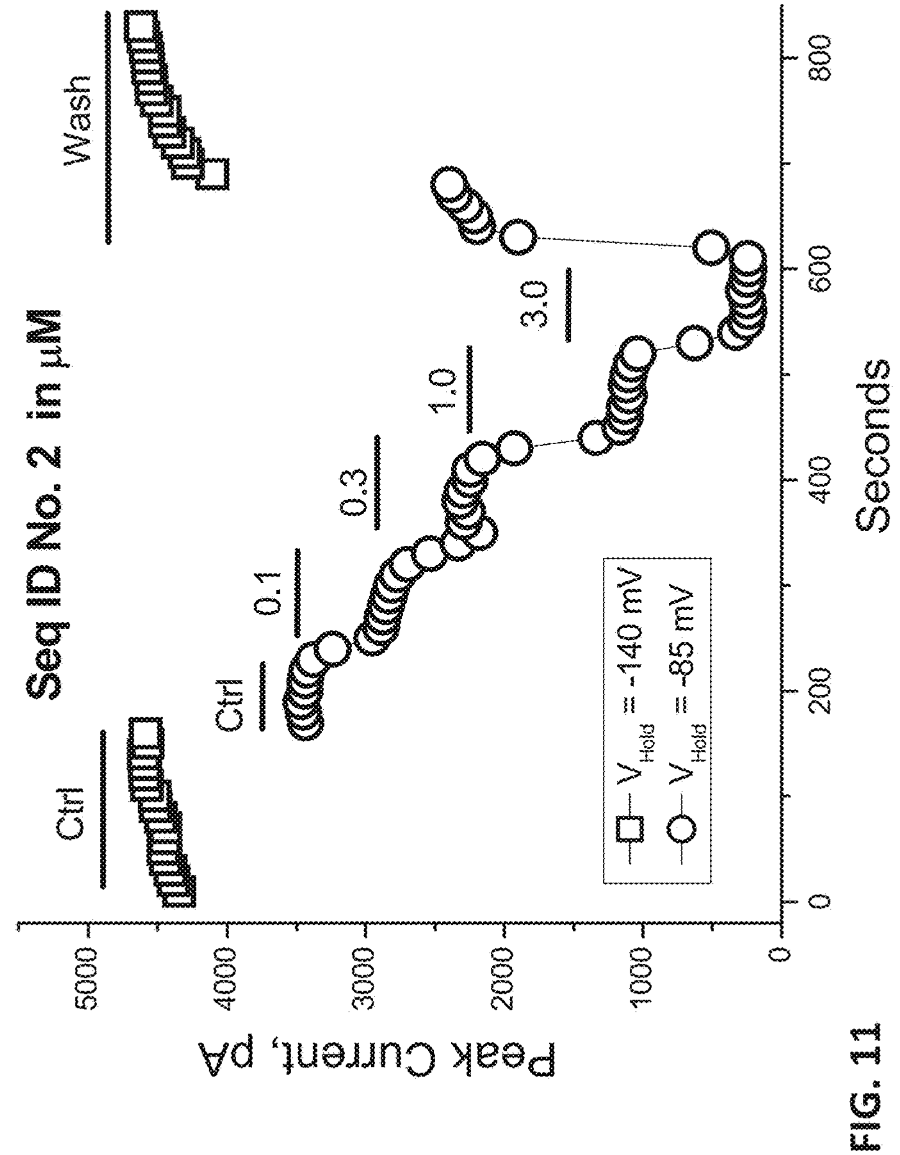
FIG. 11 shows the time course of increasing concentrations of JzTx-V(1-29) (SEQ ID NO:2) against hNav1.5 channels in HEK293 cell. Peak inward Nav currents were measured at 0 mV every 10 seconds in the presence of increasing concentrations of JzTx-V(1-29) (SEQ ID NO:2); cell was held at either −140 mV (squares), a voltage where Nav1.5 channels are completely non-inactivated, or −85 mV (circles), a voltage that yields approximately 20% inactivation. "Ctrl" indicates Nav1.5 current in the absence of JzTx-V(1-29) (SEQ ID NO:2) and "Wash" indicates Nav1.5 current following removal of JzTx-V(1-29) (SEQ ID NO:2).
Figure 12:
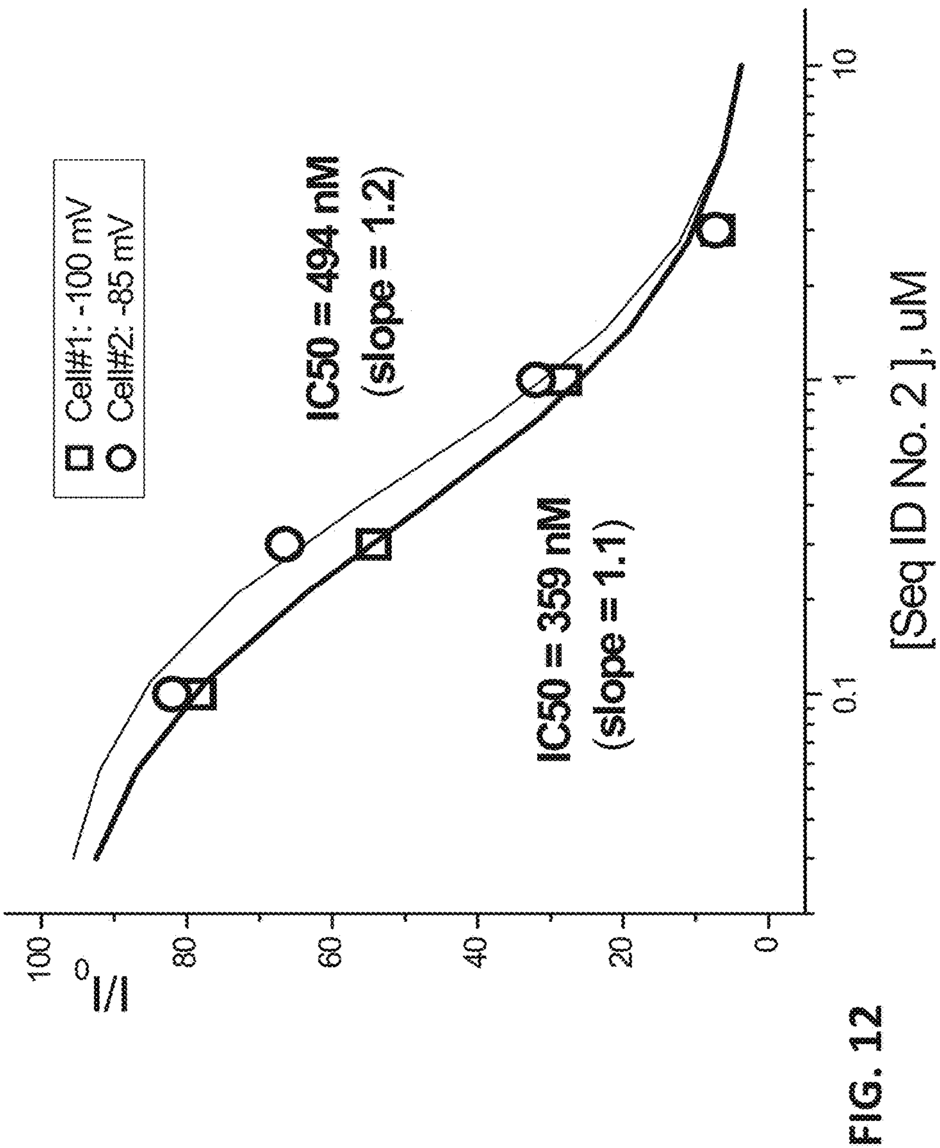
FIG. 12 shows the dose-response curves of JzTx-V(1-29) (SEQ ID NO:2) against hNav1.5 channels in two separate HEK293 cells. Peak inward Nav1.5 currents were measured at 0 mV in the presence of increasing concentrations of JzTx-V(1-29) (SEQ ID NO:2); cells were held at a voltage that yielded 20% inactivation.
Figure 13:
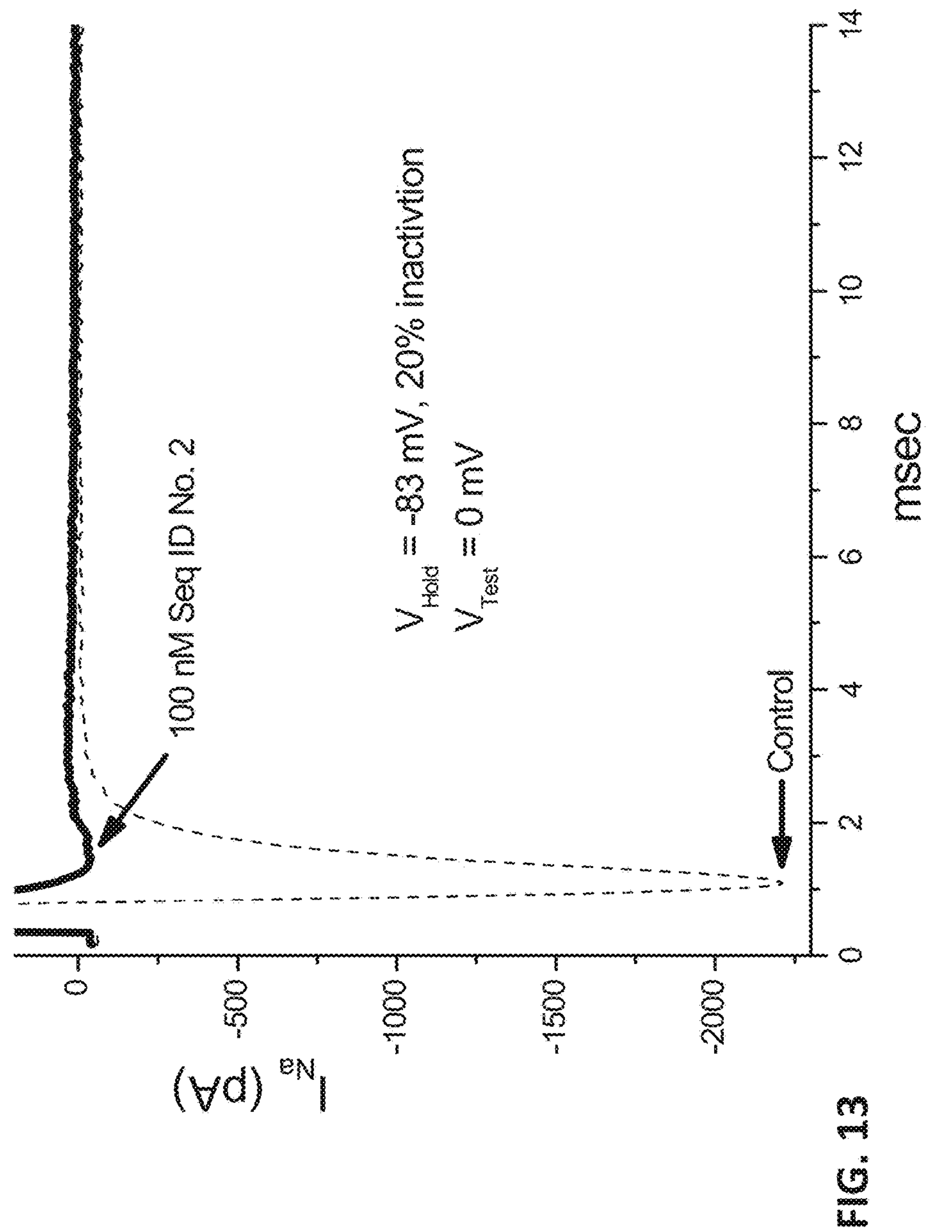
FIG. 13 shows the effect of JzTx-V(1-29) (SEQ ID NO:2) on hNav1.4 channels in HEK293 cell. Cell was held at −83 mV and peak inward Nav currents were measured at 0 mV. "Control" trace shows Nav1.4 current before JzTx-V(1-29) (SEQ ID NO:2), "100 nM Seq ID No. 2" trace shows Nav1.4 current after JzTx-V(1-29) (SEQ ID NO:2) addition. Note that 100 nM JzTx-V(1-29) (SEQ ID NO:2) completely blocked Nav1.4 current.
Figure 14:
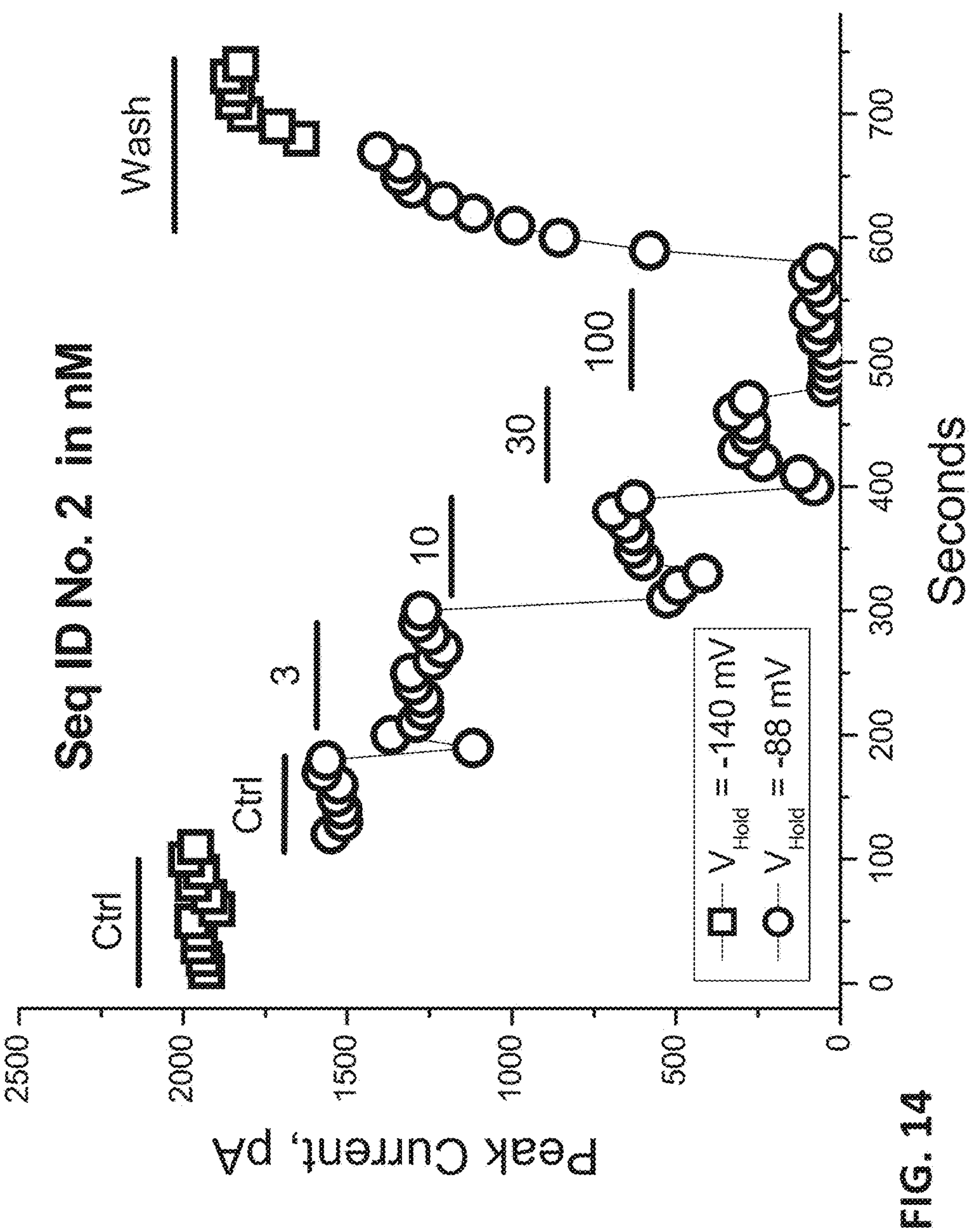
FIG. 14 shows the time course of increasing concentrations of JzTx-V(1-29) (SEQ ID NO:2) against hNav1.4 channels in HEK293 cell. Peak inward Nav currents were measured at 0 mV every 10 seconds in the presence of increasing concentrations of JzTx-V(1-29) (SEQ ID NO:2); cell was held at either −140 mV (squares), a voltage where Nav1.4 channels are completely non-inactivated, or −88 mV (circles), a voltage that yields approximately 20% inactivation. "Ctrl" indicates Nav1.4 current in the absence of JzTx-V(1-29) (SEQ ID NO:2) and "Wash" indicates Nav1.4 current following removal of JzTx-V(1-29) (SEQ ID NO:2).
Figure 15:
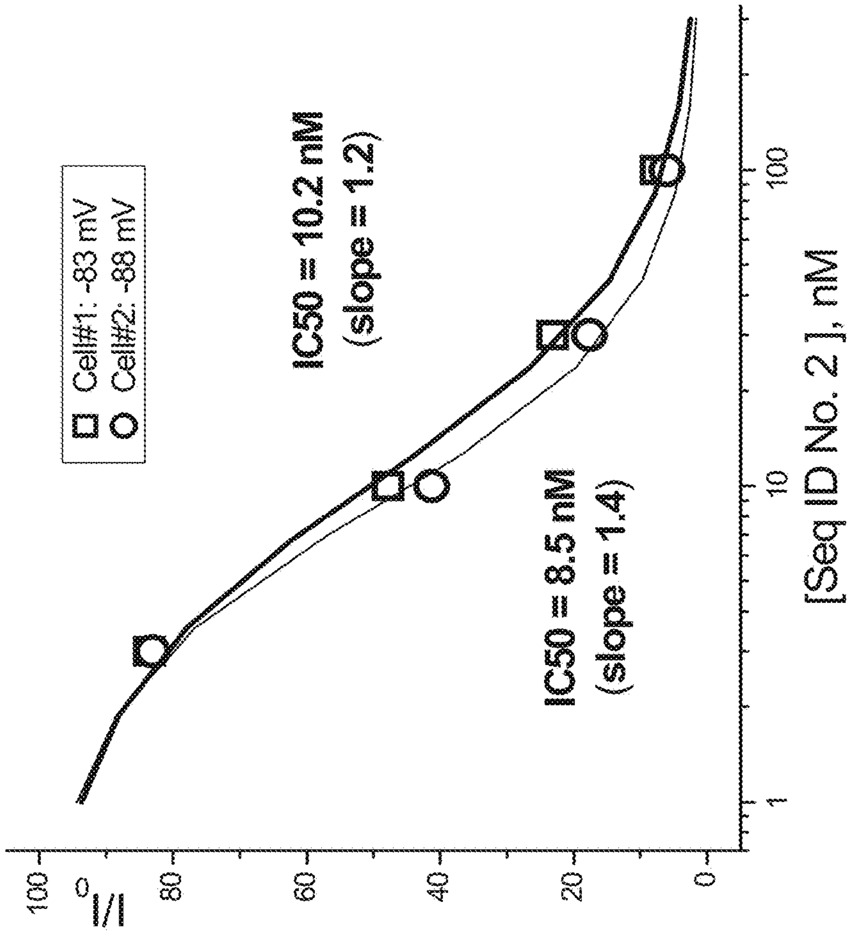
FIG. 15 shows the dose-response curves of JzTx-V(1-29) (SEQ ID NO:2) against hNav1.4 channels in two separate HEK293 cells. Peak inward Nav1.4 currents were measured at 0 mV in the presence of increasing concentrations of JzTx-V(1-29) (SEQ ID NO:2); cells were held at a voltage that yielded 20% inactivation.
Figure 16:
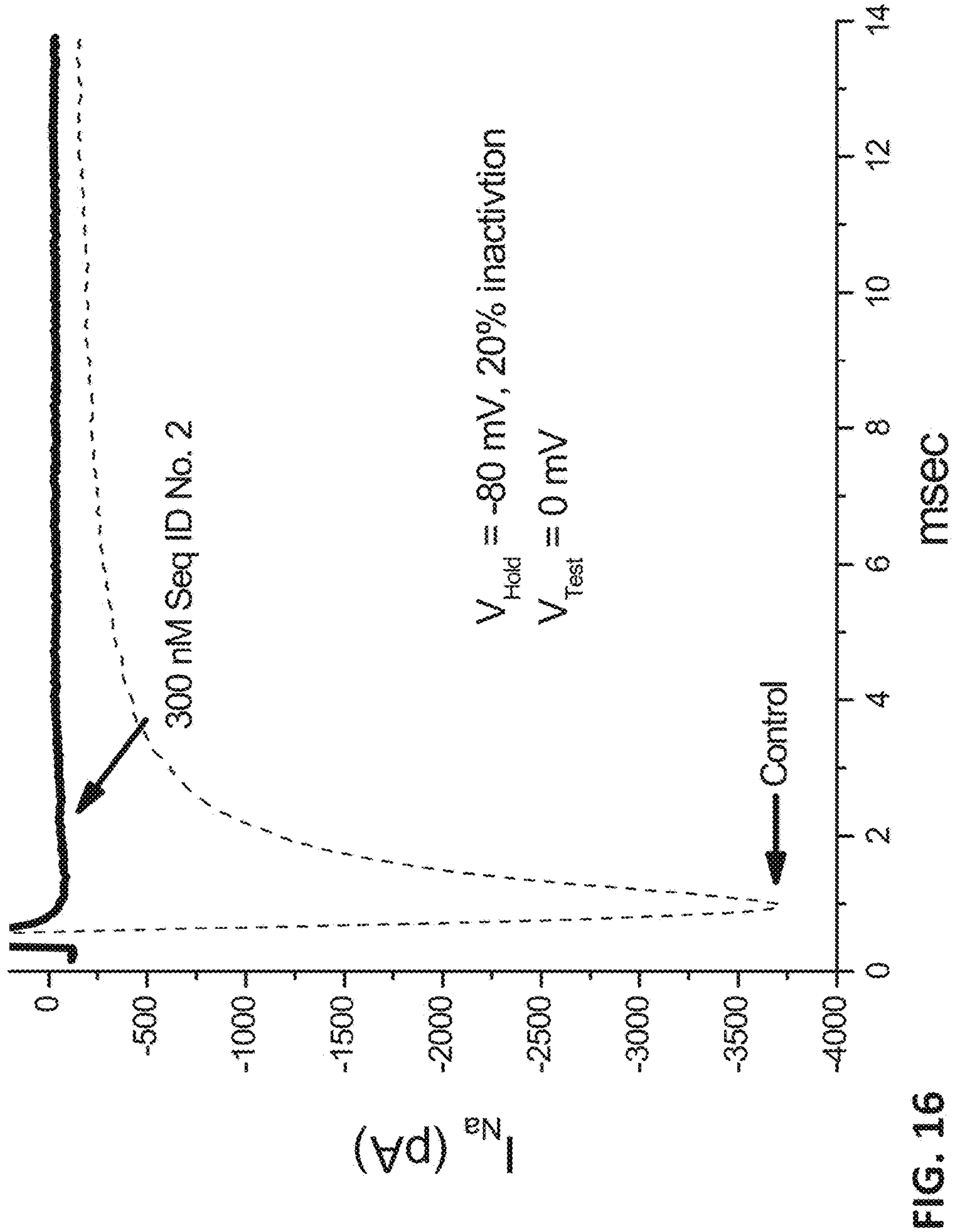
FIG. 16 shows the effect of JzTx-V(1-29) (SEQ ID NO:2) on hNav1.3 channels in CHO cell. Cell was held at −80 mV and peak inward Nav currents were measured at 0 mV. "Control" trace shows Nav1.3 current before JzTx-V(1-29) (SEQ ID NO:2), "300 nM Seq ID No. 2" trace shows Nav1.3 current after JzTx-V(1-29) (SEQ ID NO:2) addition. Note that 300 nM JzTx-V(1-29) (SEQ ID NO:2) completely blocked Nav1.3 current.
Figure 17:
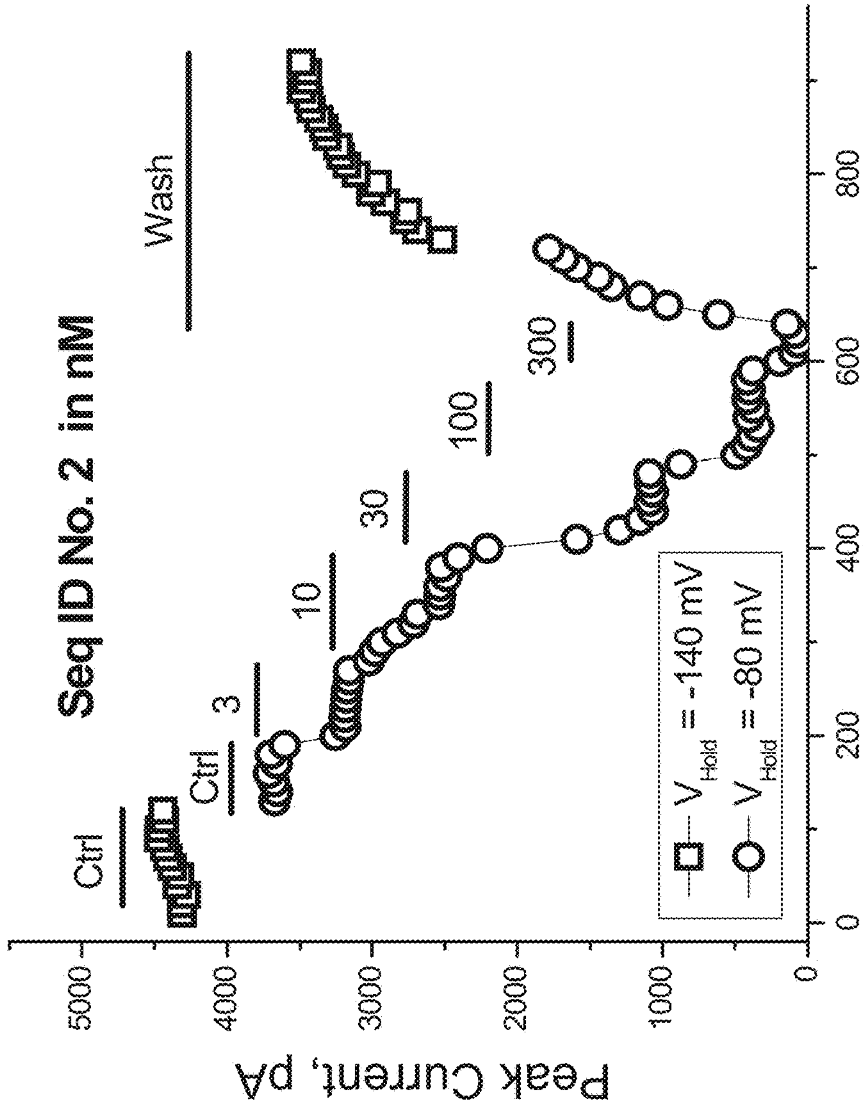
FIG. 17 shows the time course of increasing concentrations of JzTx-V(1-29) (SEQ ID NO:2) against hNav1.3 channels in CHO cell. Peak inward Nav currents were measured at 0 mV every 10 seconds in the presence of increasing concentrations of JzTx-V(1-29) (SEQ ID NO:2); cell was held at either −140 mV (squares), a voltage where Nav1.3 channels are completely non-inactivated, or −80 mV (circles), a voltage that yields approximately 20% inactivation. "Ctrl" indicates Nav1.3 current in the absence of JzTx-V(1-29) (SEQ ID NO:2) and "Wash" indicates Nav1.3 current following removal of JzTx-V(1-29) (SEQ ID NO:2).
Figure 18:
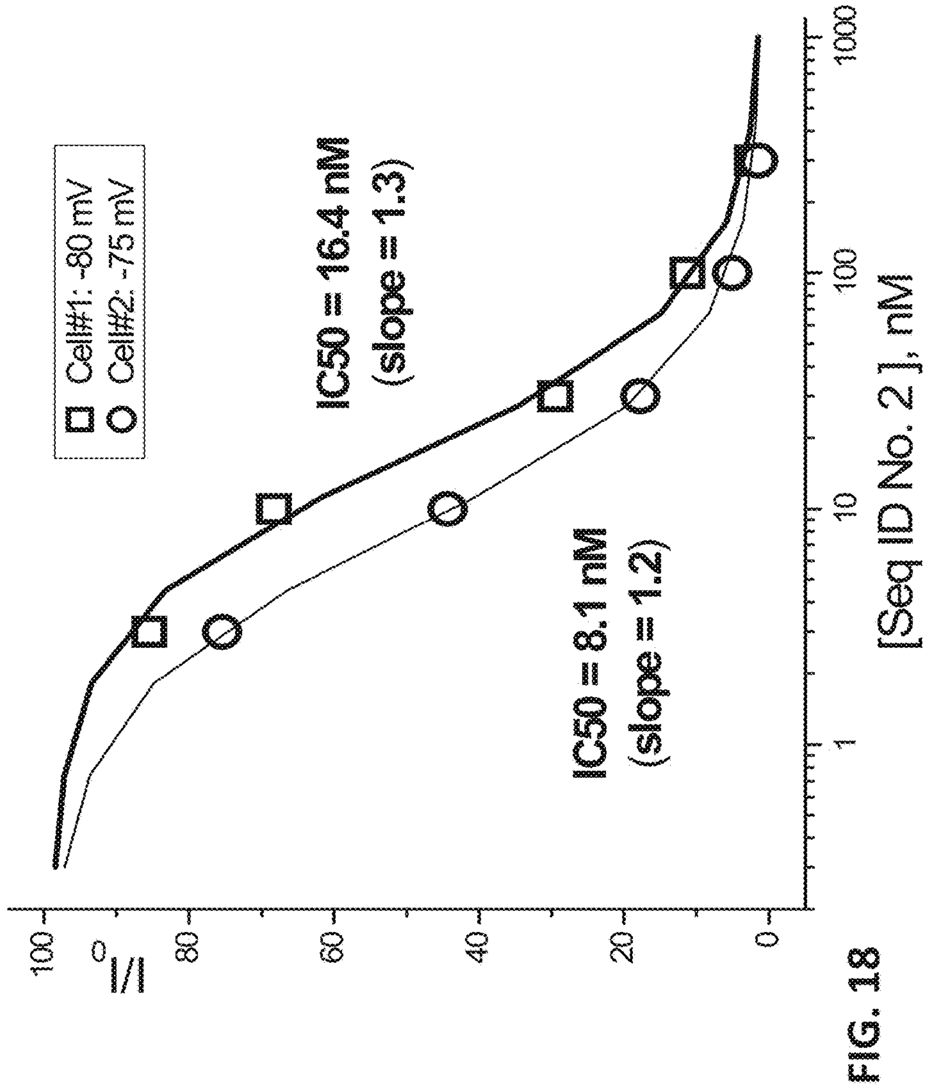
FIG. 18 shows the dose-response curves of JzTx-V(1-29) (SEQ ID NO:2) against hNav1.3 channels in two separate CHO cells. Peak inward Nav1.3 currents were measured at 0 mV in the presence of increasing concentrations of JzTx-V(1-29) (SEQ ID NO:2); cells were held at a voltage that yielded 20% inactivation.
Figure 19:
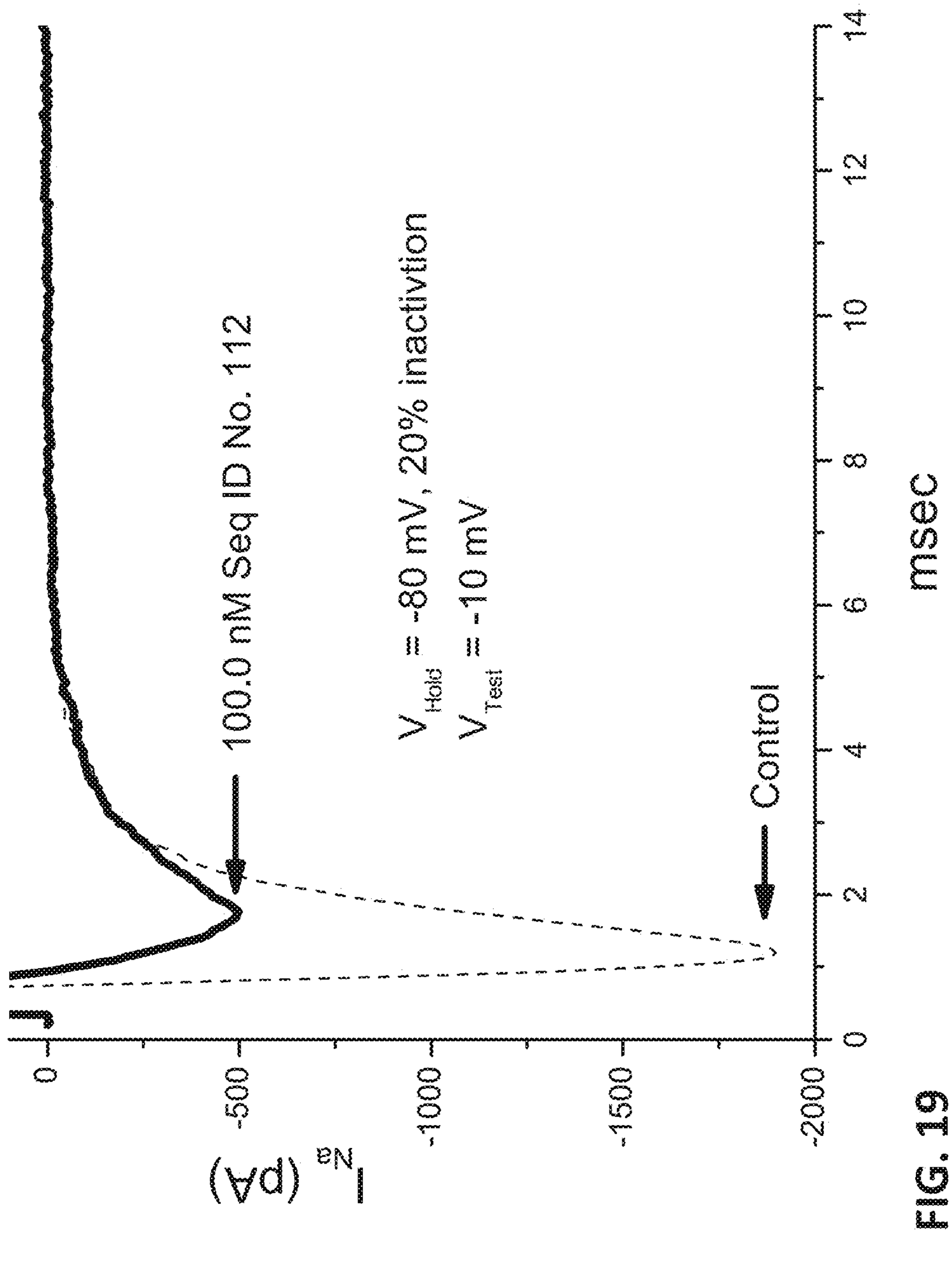
FIG. 19 shows the effect of [Glu20,Trp29]JzTx-V(1-29) (SEQ ID NO:112) on hNav1.7 channels in HEK293 cell. Cell was held at −80 mV and peak inward Nav currents were measured at −10 mV. "Control" trace shows Nav1.7 current before [Glu20,Trp29]JzTx-V(1-29) (SEQ ID NO:112) addition, and "100.0 nM SEQ ID No. 112" trace shows Nav current after [Glu20,Trp29]JzTx-V(1-29) (SEQ ID NO:112) addition. Note that 100 nM [Glu20,Trp29]JzTx-V(1-29) (SEQ ID NO:112) only blocked approximately 80% of Nav1.7 current.
Figure 20:
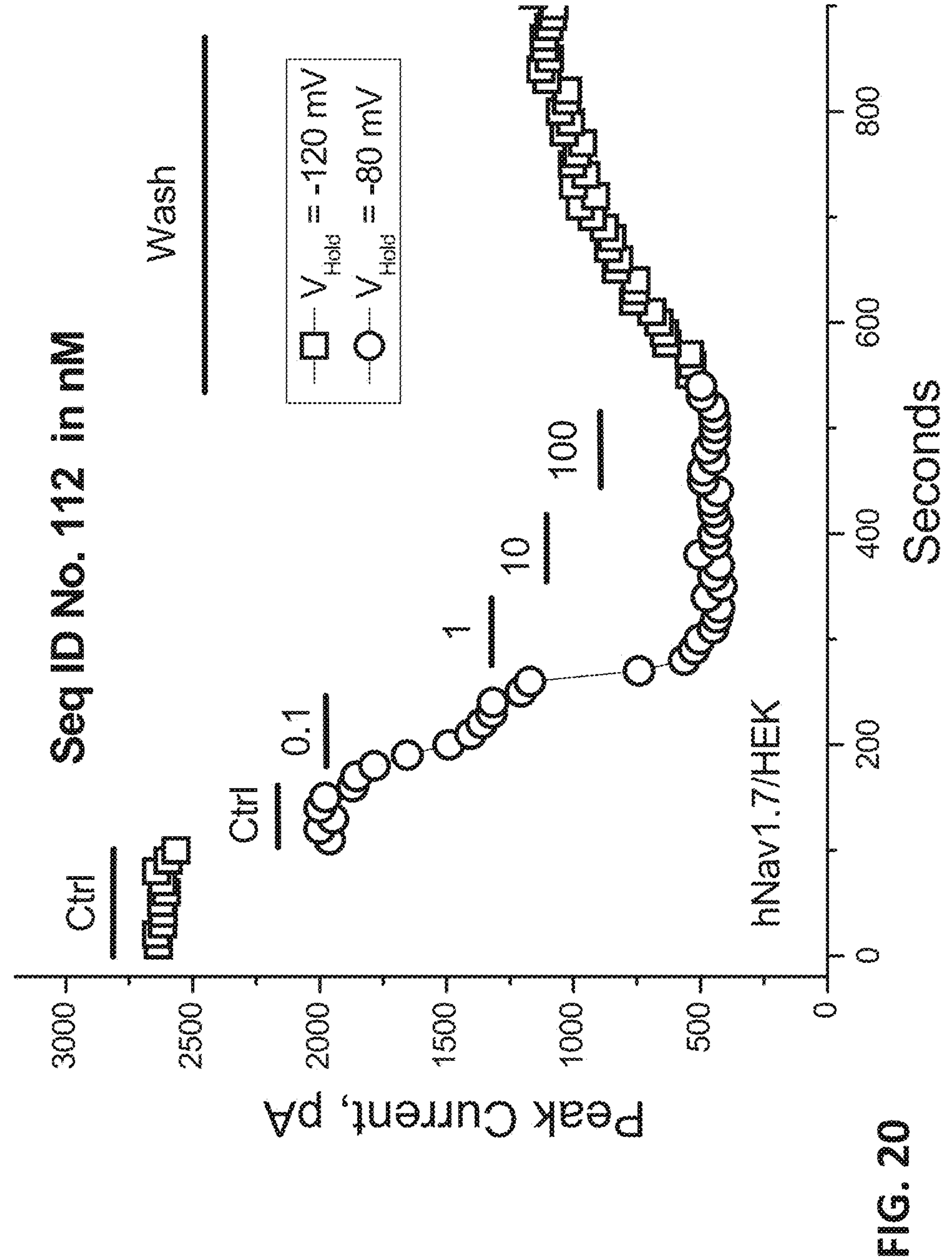
FIG. 20 shows the time course of increasing concentrations of [Glu20,Trp29]JzTx-V(1-29) (SEQ ID NO:112) against hNav1.7 channel in HEK293 cell. Peak inward Nav currents were measured at −10 mV every 10 seconds in the presence of increasing concentrations of [Glu20,Trp29] JzTx-V(1-29) (SEQ ID NO:112); cell was held at either −120 mV (squares), a voltage where Nav1.7 channels are completely non-inactivated, or −80 mV (circles), a voltage that yields approximately 20% inactivation. "Ctrl" indicates Nav1.7 current in the absence of [Glu20,Trp29]JzTx-V(1-29) (SEQ ID NO:112) and "Wash" indicates Nav1.7 current following removal of [Glu20,Trp29]JzTx-V(1-29) (SEQ ID NO:112). Note that 100 nM [Glu20,Trp29]JzTx-V(1-29) (SEQ ID NO:112) did not completely block Nav1.7 current.
Figure 21:
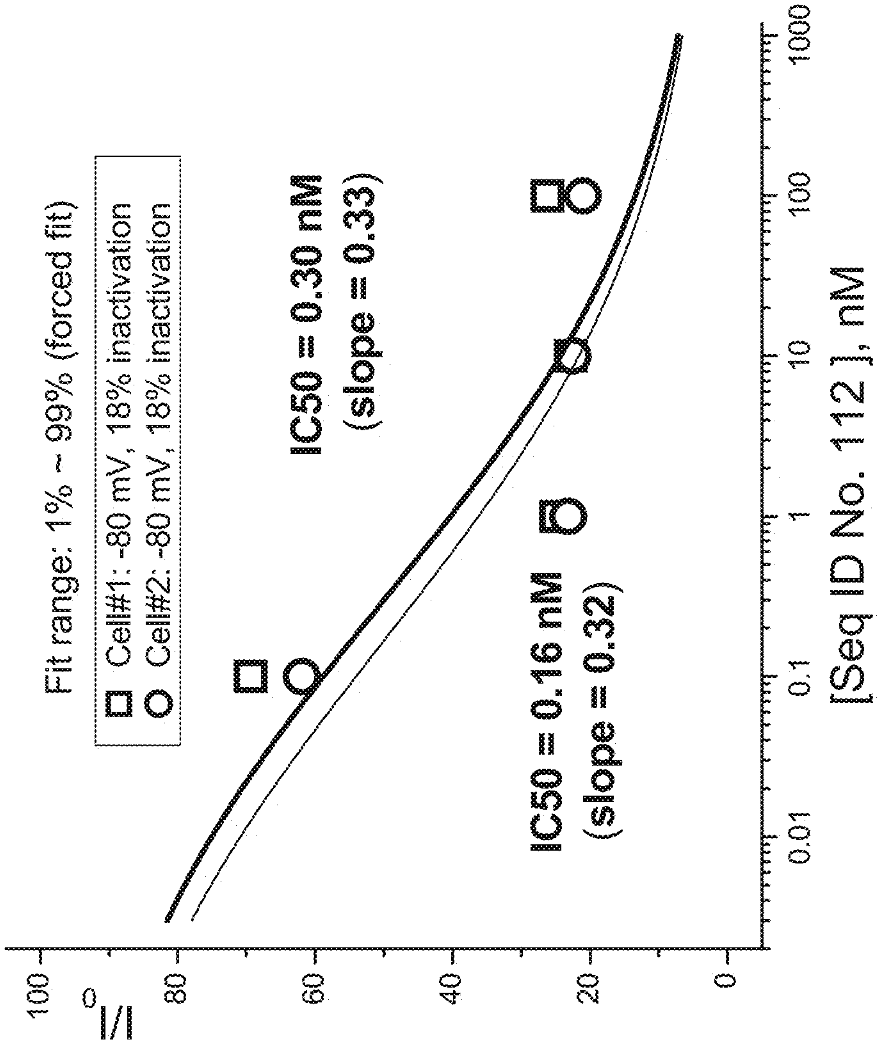
FIG. 21 shows the dose-response curves of [Glu20,Trp29] JzTx-V(1-29) (SEQ ID NO:112) against hNav1.7 channels in two separate HEK293 cells. Peak inward Nav1.7 currents were measured at −10 mV in the presence of increasing concentrations of [Glu20,Trp29]JzTx-V(1-29) (SEQ ID NO:112); cells were held at a voltage that yielded around 20% inactivation. $IC_{50}$ values are estimated since complete block of Nav1.7 was not observed at the highest concentration of [Glu20,Trp29]JzTx-V(1-29) (SEQ ID NO:112) tested.

Manual whole cell patch clamp electrophysiology was performed on JzTx-V(1-29) (SEQ ID NO:2) on human clones of Nav1.8, Nav1.7, Nav1.5, Nav1.4, and Nav1.3. (See Table 14.) Testing with 1.0 μM JzTx-V with 0.5 μM TTX showed only partial inhibition of the hNav1.8 current. (See, FIG. 4). The effects of JzTx-V addition in increasing concentrations and wash out on hNav1.8 current were recorded. (See, FIG. 5). The average $IC_{50}$ value of hNav1.8 inhibition for JzTx-V was 530 nM. (See, FIG. 6). Testing with 1 nM JzTx-V showed complete inhibition of the hNav1.7 current. (See, FIG. 7). The effects of JzTx-V addition in increasing concentrations and wash out on hNav1.7 current were recorded. (See FIG. 8). The average $IC_{50}$ value of hNav1.7 inhibition for JzTx-V was 0.1615 nM. (See FIG. 9). Testing with 3.0 μM JzTx-V showed nearly complete inhibition of the hNav1.5 current. (See FIG. 10). The effects of JzTx-V addition in increasing concentrations and wash out on hNav1.5 current were recorded. (See FIG. 11). The average $IC_{50}$ value of hNav1.5 inhibition for JzTx-V was 426.5 nM. (See FIG. 12). Testing with 100 nM JzTx-V showed complete inhibition of the hNav1.4 current. (See FIG. 13). The effects of JzTx-V addition in increasing concentrations and wash out on hNav1.4 current were recorded. (See FIG. 14). The average $IC_{50}$ value of hNav1.4 inhibition for JzTx-V was 9.35 nM for the partially inactivated state. (See FIG. 15). Testing with 300 nM JzTx-V showed complete inhibition of the hNav1.3 current. (See FIG. 16). The effects of JzTx-V addition in increasing concentrations and wash out on hNav1.3 current were recorded. (See FIG. 17). The average $IC_{50}$ value of hNav1.3 inhibition for JzTx-V was 12.25 nM. (See FIG. 18). These results demonstrate that JzTx-V (SEQ ID NO:2) is a potent peptide inhibitor of hNav1.7 with 50-fold selectivity against hNav1.3 and hNav1.4 and 2000-fold selectivity against hNav1.5 and hNav1.8. Manual whole cell patch clamp electrophysiology was also performed on [Glu20,Trp29] JzTx-V(1-29) (SEQ ID NO:112) and Pra-[Nle6]JzTx-V(1-29) (SEQ ID NO:425) on the human clone of Nav1.7. Testing with 100 nM [Glu20,Trp29]JzTx-V(1-29) showed only partial inhibition of the hNav1.7 current. (See FIG. 19). The effects of [Glu20,Trp29]JzTx-V(1-29) addition in increasing concentrations and wash out on hNav1.7 current were recorded. (See FIG. 20). The average $IC_{50}$ value of hNav1.7 inhibition for [Glu20,Trp29]JzTx-V(1-29) was 0.23 nM. (See FIG. 21). These results demonstrate that

Figure 22:
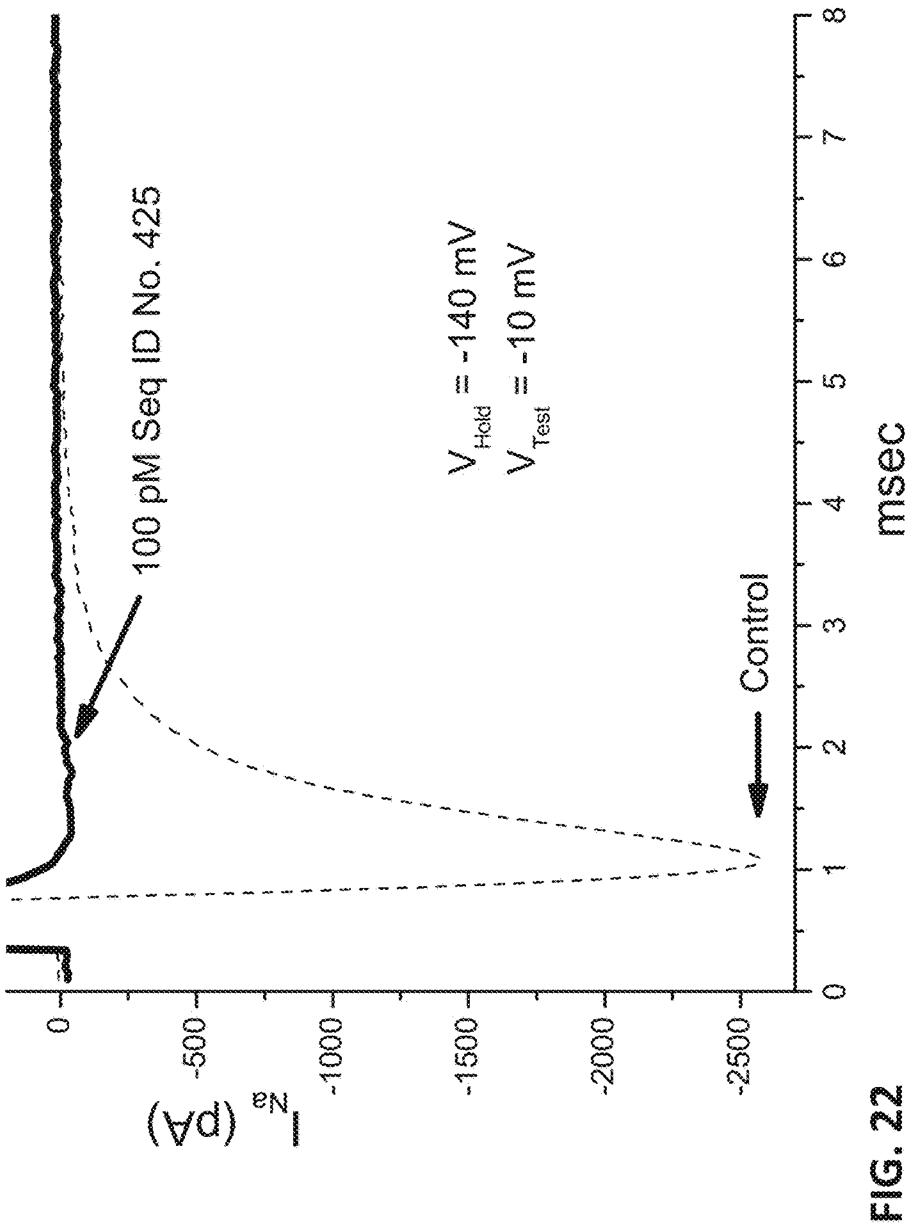
FIG. 22 shows the effect of Pra-[Nle6]JzTx-V(1-29) (SEQ ID NO:425) on hNav1.7 channels in HEK293 cell. Cell was held at −140 mV and peak inward Nav currents were measured at −10 mV. "Control" trace shows Nav1.7 current before Pra-[Nle6]JzTx-V(1-29) (SEQ ID NO:425) and '100 pM Seq ID No. 425' trace shows Nav current after Pra-[Nle6]JzTx-V(1-29) (SEQ ID NO:425) addition. Note that 100 pM Pra-[Nle6]JzTx-V(1-29) (SEQ ID NO:425) fully blocked Nav1.7 current.
Figure 23:
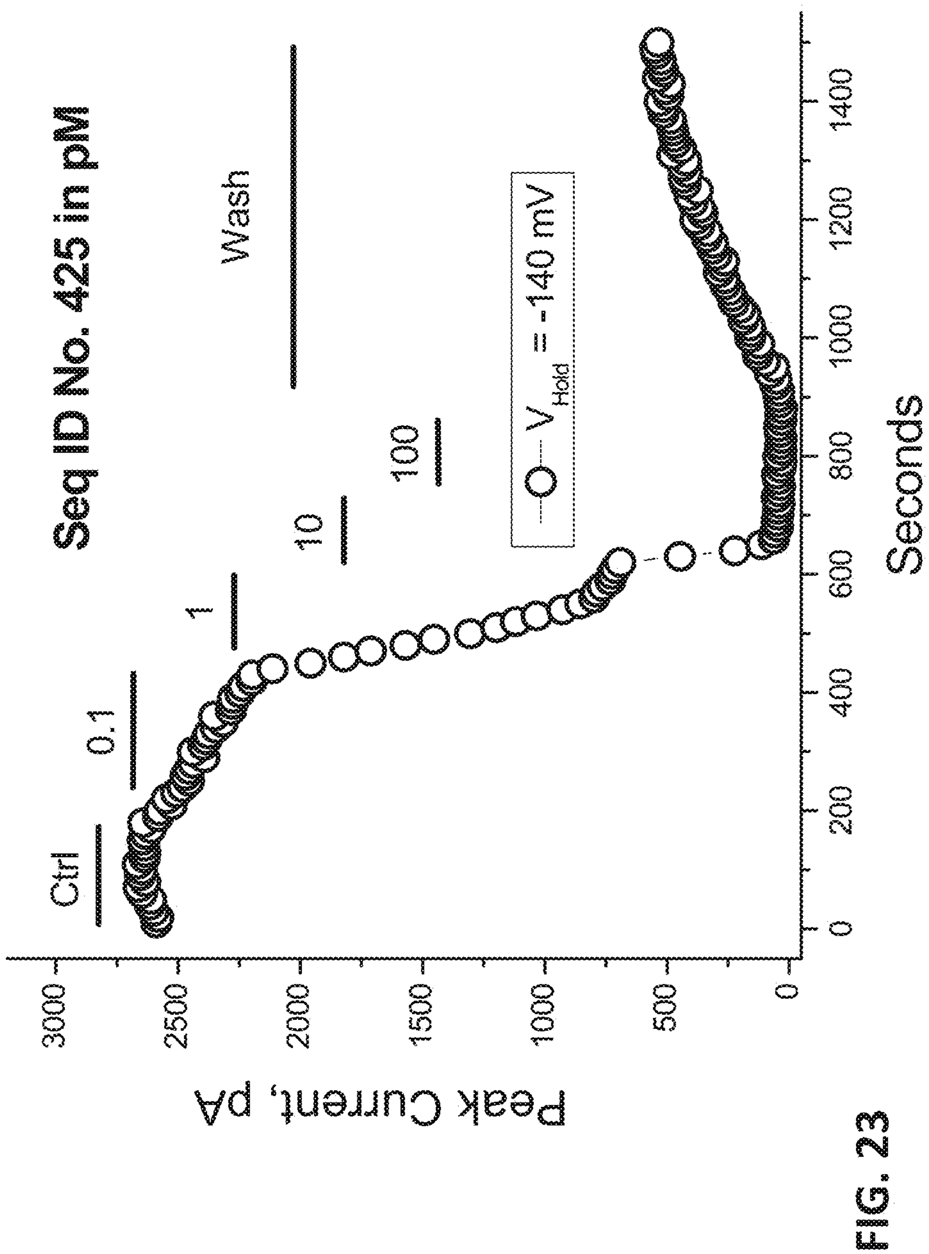
FIG. 23 shows the time course of increasing concentrations of Pra-[Nle6]JzTx-V(1-29) (SEQ ID NO:425) against hNav1.7 channel in HEK293 cell. Peak inward Nav currents were measured at −10 mV every 10 seconds in the presence of increasing concentrations of Pra-[Nle6]JzTx-V(1-29) (SEQ ID NO:425); cell was held at −140 mV, a voltage where Nav1.7 channels were fully non-inactivated. "Ctrl" indicates Nav1.7 current in the absence of Pra-[Nle6]JzTx-V(1-29) (SEQ ID NO:425) and "Wash" indicates Nav1.7 current following removal of Pra-[Nle6]JzTx-V(1-29) (SEQ ID NO:425).
Figure 24:
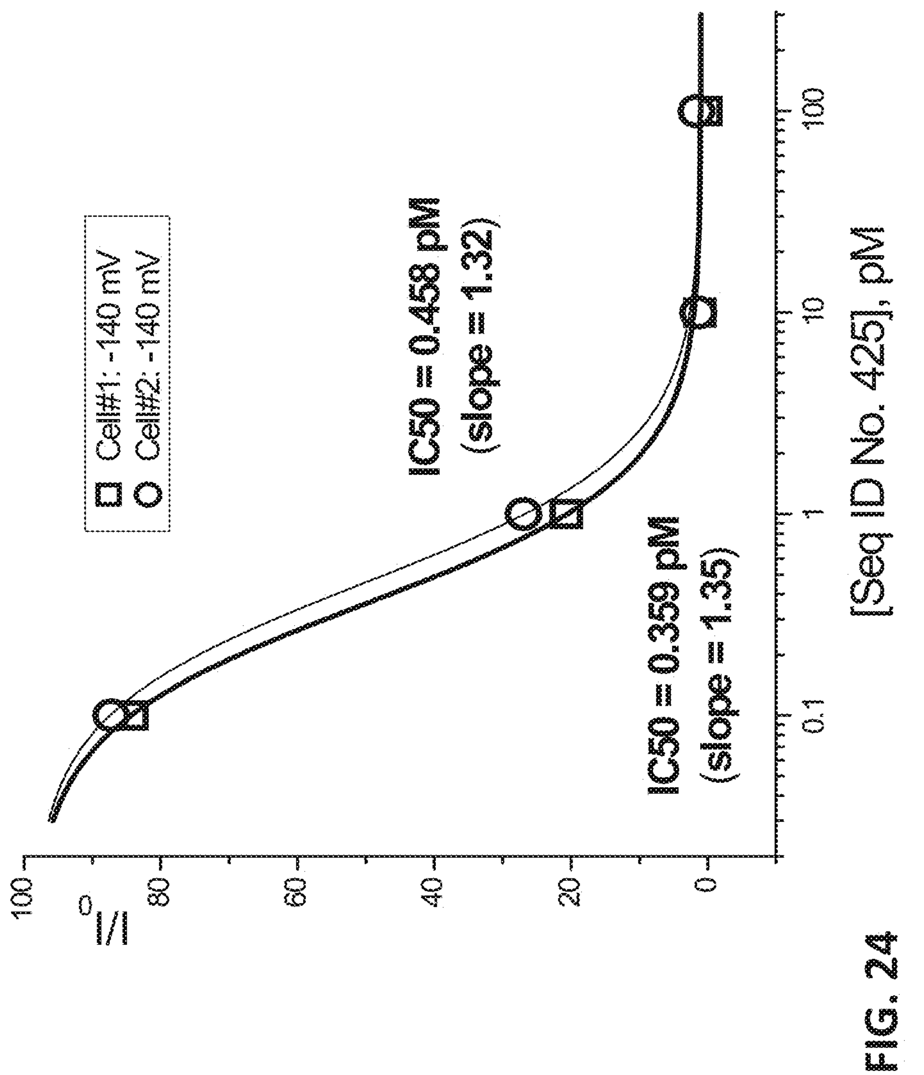
FIG. 24 shows the dose-response curves of Pra-[Nle6] JzTx-V(1-29) (SEQ ID NO:425) against hNav1.7 channels in two separate HEK293 cells. Peak inward Nav1.7 currents were measured at −10 mV in the presence of increasing concentrations of Pra-[Nle6]JzTx-V(1-29) (SEQ ID NO:425); cells were held at −140 mV, a voltage where Nav1.7 channels were fully non-inactivated.
Figure 25:
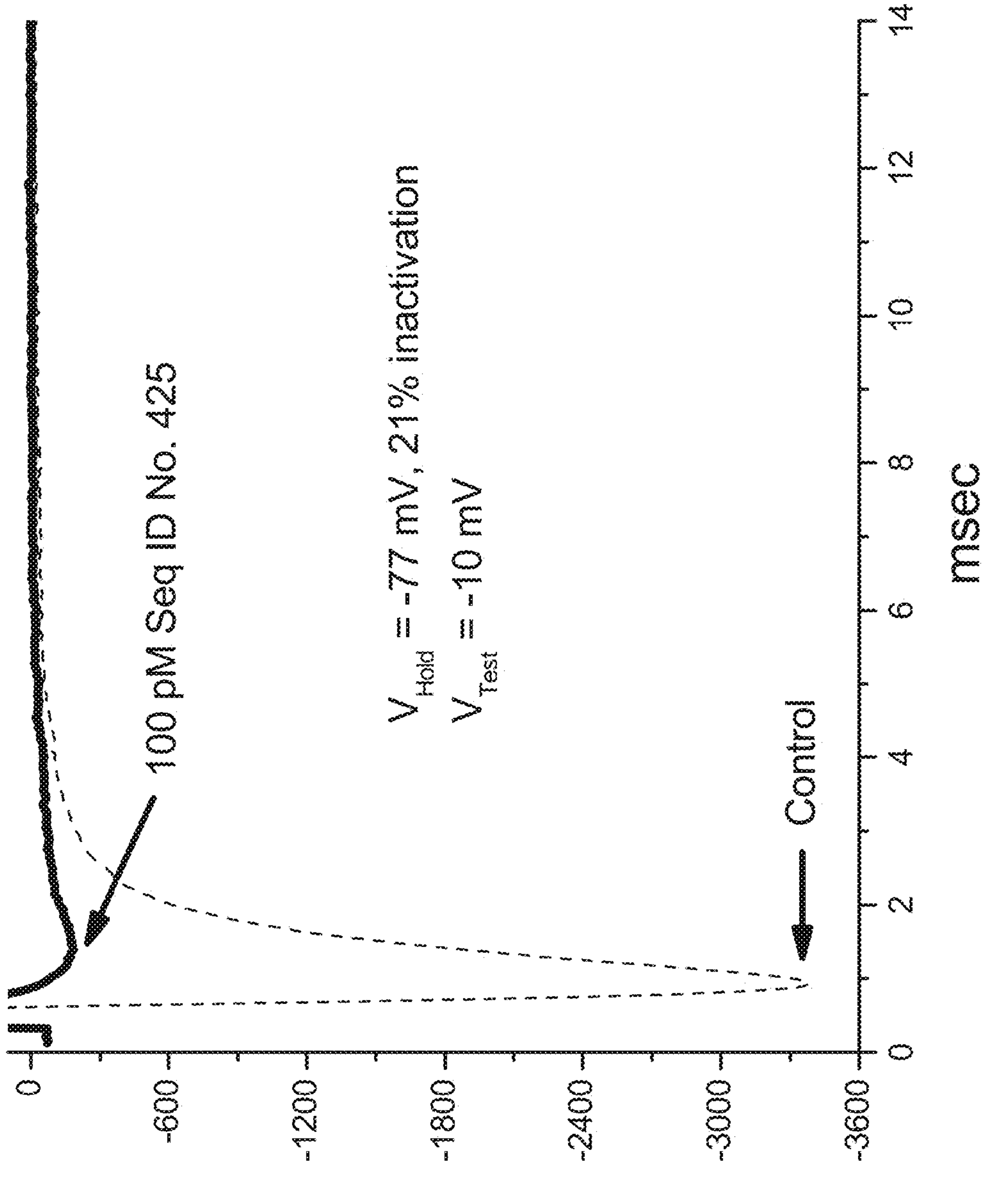
FIG. 25 shows the effect of Pra-[Nle6]JzTx-V(1-29) (SEQ ID NO:425) on hNav1.7 channels in HEK293 cell. Cell was held at −77 mV (partially inactivated state) and peak inward Nav currents were measured at −10 mV. "Control" trace shows Nav1.7 current before Pra-[Nle6] JzTx-V(1-29) (SEQ ID NO:425) and "100 pM Seq ID No. 425" trace shows Nav current after Pra-[Nle6]JzTx-V(1-29) (SEQ ID NO:425) addition. Note that 100 pM Pra-[Nle6] JzTx-V(1-29) (SEQ ID NO:425) fully blocked Nav1.7 current.
Figure 26:
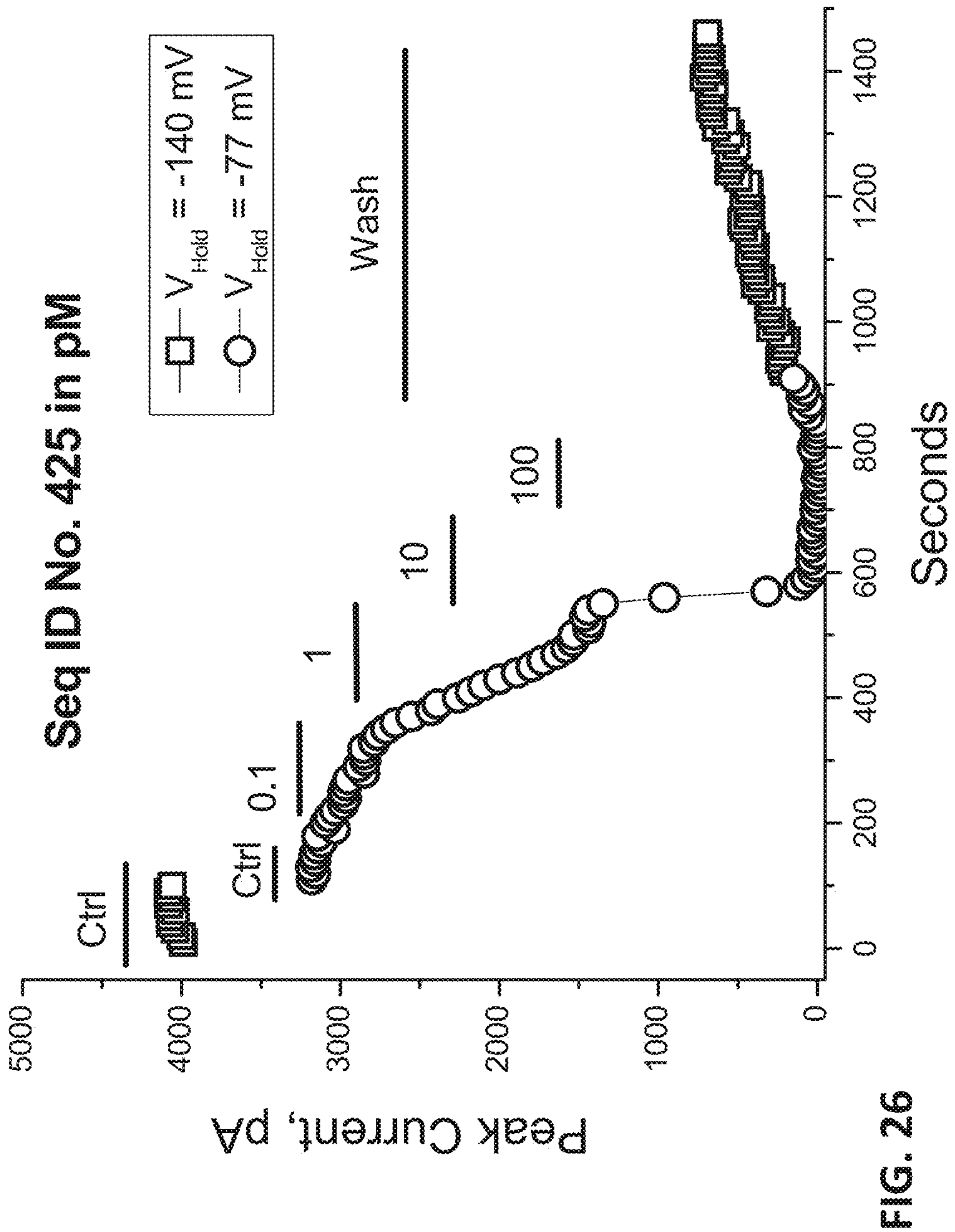
FIG. 26 shows the time course of increasing concentrations of Pra-[Nle6]JzTx-V(1-29) (SEQ ID NO:425) against hNav1.7 channel in HEK293 cell. Peak inward Nav currents were measured at −10 mV every 10 seconds in the presence of increasing concentrations of Pra-[Nle6]JzTx-V(1-29) (SEQ ID NO:425); cell was held at either −140 mV (squares), a voltage where Nav1.7 channels are completely non-inactivated, or −77 mV (circles), a voltage that yields approximately 20% inactivation. "Ctrl" indicates Nav1.7 current in the absence of Pra-[Nle6]JzTx-V(1-29) (SEQ ID NO:425) and "Wash" indicates Nav1.7 current following removal of Pra-[Nle6]JzTx-V(1-29) (SEQ ID NO:425).
Figure 27:
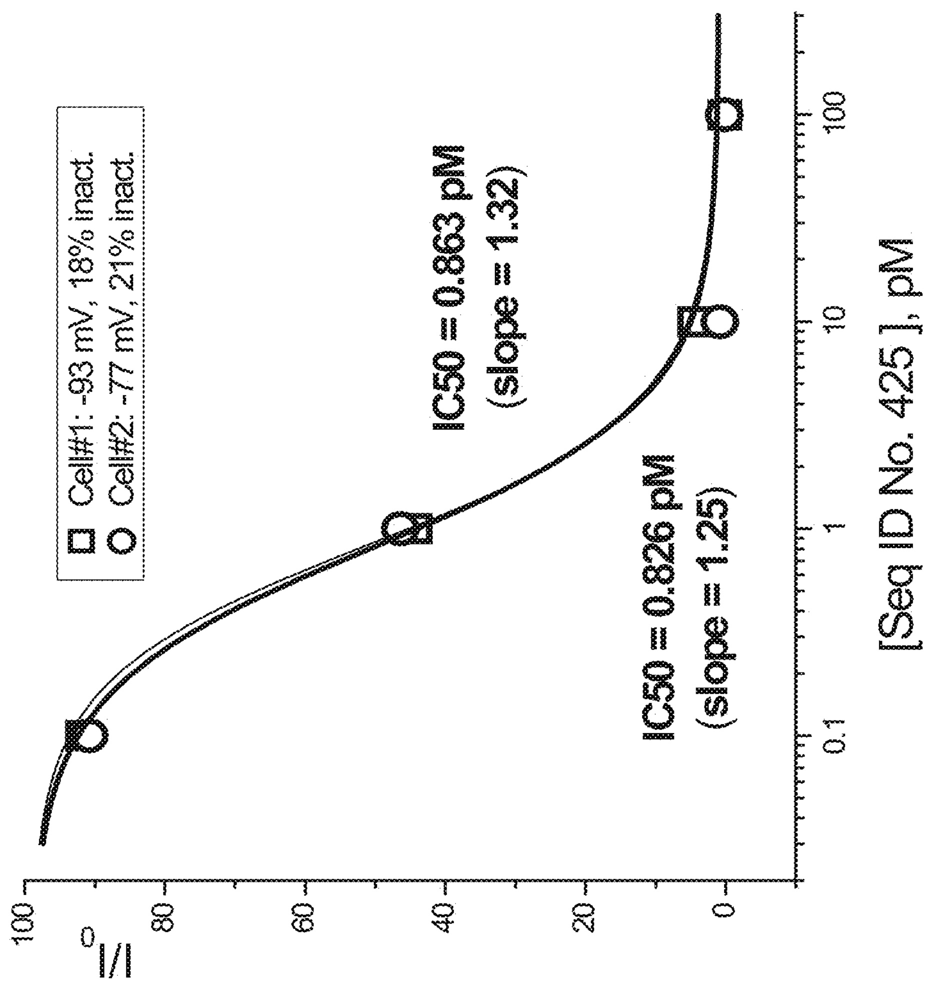
FIG. 27 shows the dose-response curves of Pra-[Nle6] JzTx-V(1-29) (SEQ ID NO:425) against hNav1.7 channels in two separate HEK293 cells. Peak inward Nav1.7 currents were measured at −10 mV in the presence of increasing concentrations of Pra-[Nle6]JzTx-V(1-29) (SEQ ID NO:425); cells were held at a voltage that yielded around 20% inactivation.

[Glu20,Trp29]JzTx-V(1-29) is also a potent inhibitor of hNav1.7. Testing with 100 pM Pra-[Nle6]JzTx-V(1-29) showed complete inhibition of the hNav1.7 current (fully non-inactivated state). (See FIG. 22). The effects of Pra-[Nle6]JzTx-V(1-29) addition in increasing concentrations and wash out on hNav1.7 current (fully non-inactivated state) were recorded. (See FIG. 23). The average $IC_{50}$ value of hNav1.7 inhibition (fully non-inactivated state) for Pra-[Nle6]JzTx-V(1-29) was 0.4085 pM. (See FIG. 24). Testing with 100 pM Pra-[Nle6]JzTx-V(1-29) showed complete inhibition of the hNav1.7 current (partially inactivated state). (See FIG. 25). The effects of Pra-[Nle6]JzTx-V(1-29) addition in increasing concentrations and wash out on hNav1.7 current (partially inactivated state) were recorded. (See FIG. 26). The average $IC_{50}$ value of hNav1.7 inhibition (partially inactivated state) for Pra-[Nle6]JzTx-V(1-29) was 0.8445 pM. (See FIG. 27). These results demonstrate that Pra-[Nle6]JzTx-V(1-29) is an extremely potent inhibitor of hNav1.7 in the WCPC format with a 190-fold improvement in potency over the wild type JzTx-V. Manual whole cell patch clamp electrophysiology was also performed with Pra-[Nle6,Glu28]JzTx-V(1-29) (SEQ ID NO:328) on the human clones of Nav1.1, Nav1.2, Nav1.3, Nav1.4, Nav1.5, Nav1.6, Nav1.7, and Nav1.8. (See FIGS. 102-125 and Table 14). These results demonstrate that Pra-[Nle6,Glu28]JzTx-V(1-29) (SEQ ID NO:328) has sub-nanomolar potency against Nav1.7 with >30-fold selectivity against other human VGSCs. Manual whole cell patch clamp electrophysiology was also performed with Pra-[Nle6; 5-BrW24; Glu28]JzTx-V(1-29) (SEQ ID NO:858) on the human clone of Nav1.7. (See FIGS. 156-158 and Table 14). These results confirm that Pra-[Nle6; 5-BrW24; Glu28]JzTx-V(1-29) (SEQ ID NO:858) is a sub-nanomolar potent inhibitor of hNav1.7.

Figure 28:
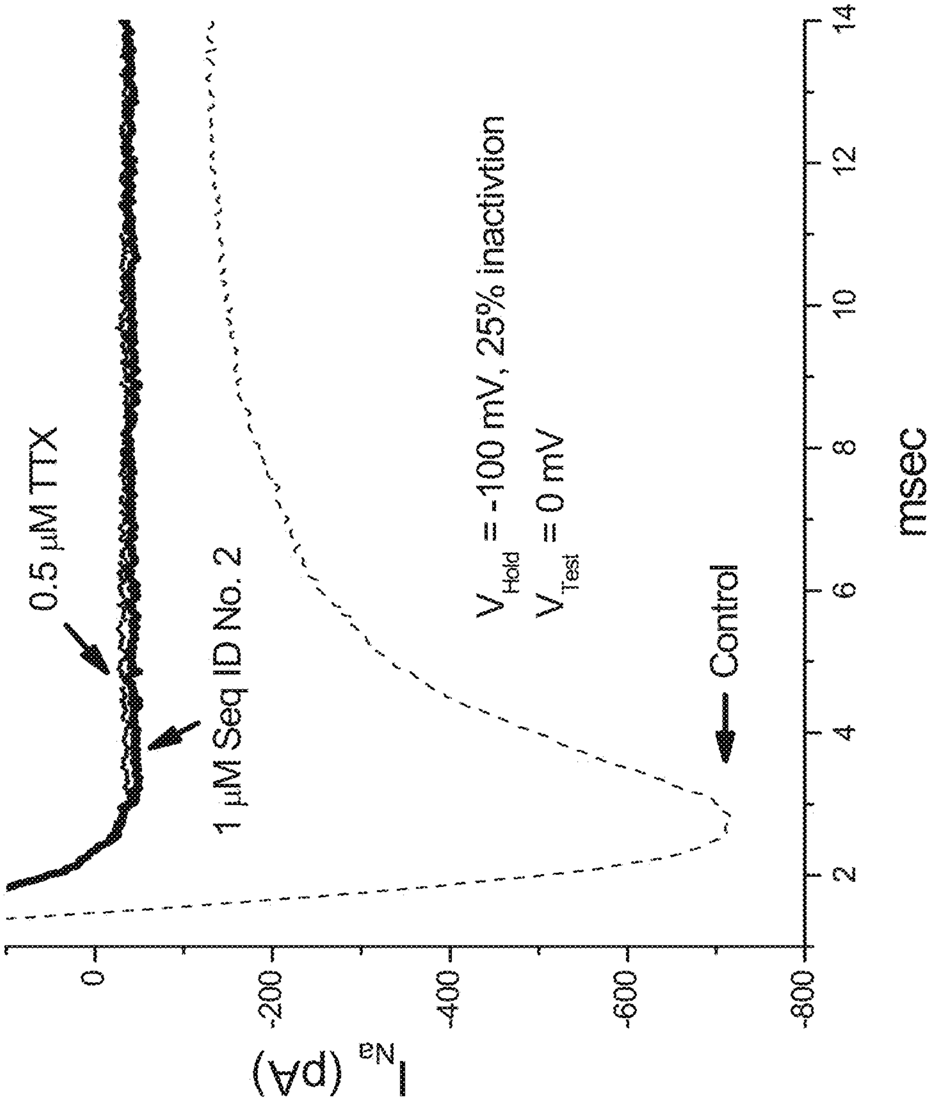
FIG. 28 shows the effect of JzTx-V(1-29) (SEQ ID NO:2) on TTX-sensitive Nav channels in mouse DRG neuron. Cell was held at −100 mV and peak inward Nav currents were measured at 0 mV. "Control" trace shows Nav current before JzTx-V(1-29) (SEQ ID NO:2), "1 μM Seq ID No. 2" trace shows Nav current after JzTx-V(1-29) (SEQ ID NO:2) addition, and "0.5 μM TTX" trace shows Nav current after TTX. Note that 1 μM JzTx-V(1-29) (SEQ ID NO:2) and 0.5 μM TTX both completely blocked TTX-sensitive Nav current.
Figure 29:
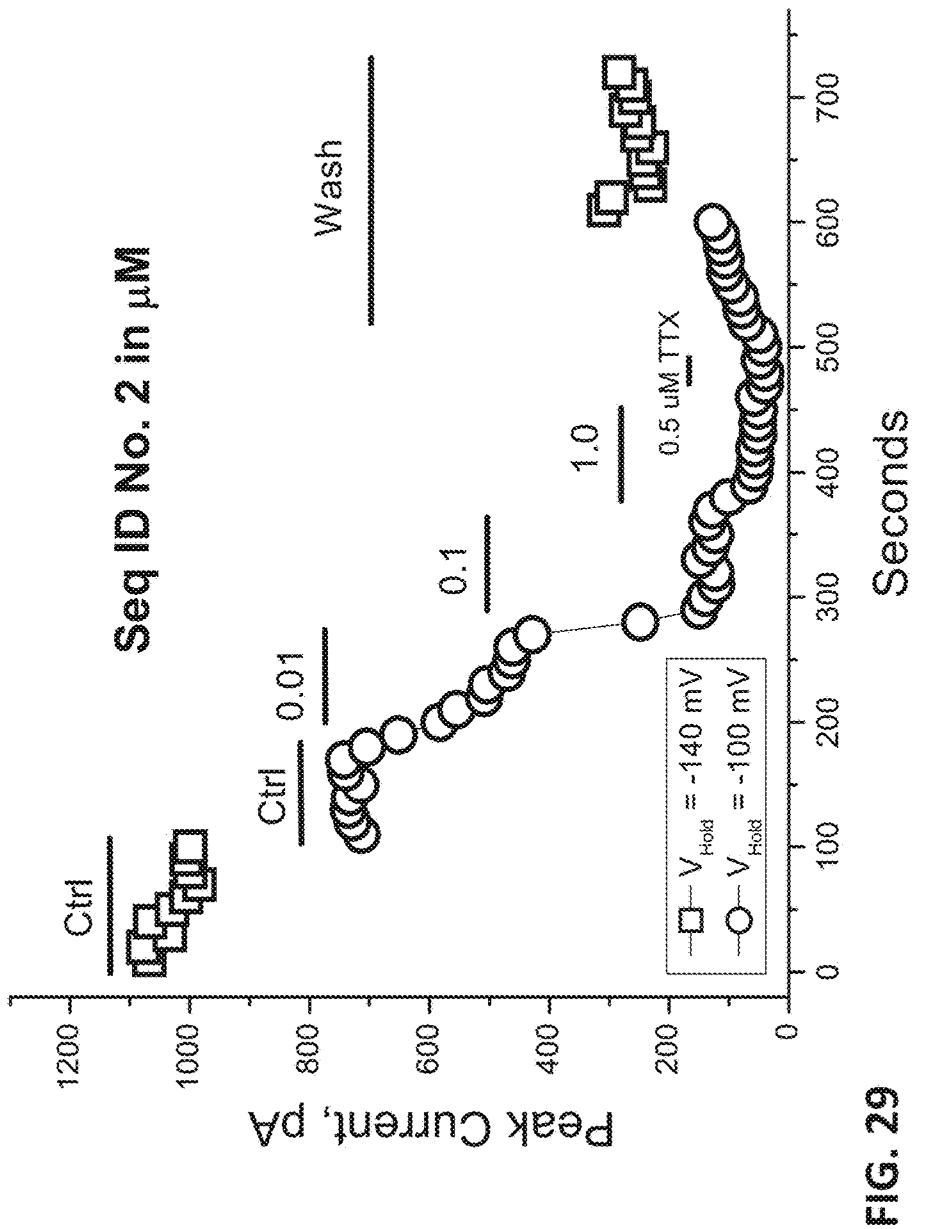
FIG. 29 shows the time course of increasing concentrations of JzTx-V(1-29) (SEQ ID NO:2) against TTX-sensitive Nav channels in mouse DRG neuron. Peak inward Nav currents were measured at 0 mV every 10 seconds in the presence of increasing concentrations of JzTx-V(1-29) (SEQ ID NO:2); cell was held at either −140 mV (squares), a voltage where Nav channels are completely non-inactivated, or −100 mV (circles), a voltage that yields approximately 25% inactivation. "Ctrl" indicates Nav current in the absence of JzTx-V(1-29) (SEQ ID NO:2), "TTX" indicates Nav current in the presence of 0.5 μM TTX, and "Wash" indicates Nav current following removal of JzTx-V(1-29) (SEQ ID NO:2) and TTX. Note that JzTx-V(1-29) (SEQ ID NO:2) blocked nearly all TTX-sensitive Nav current.
Figure 30:
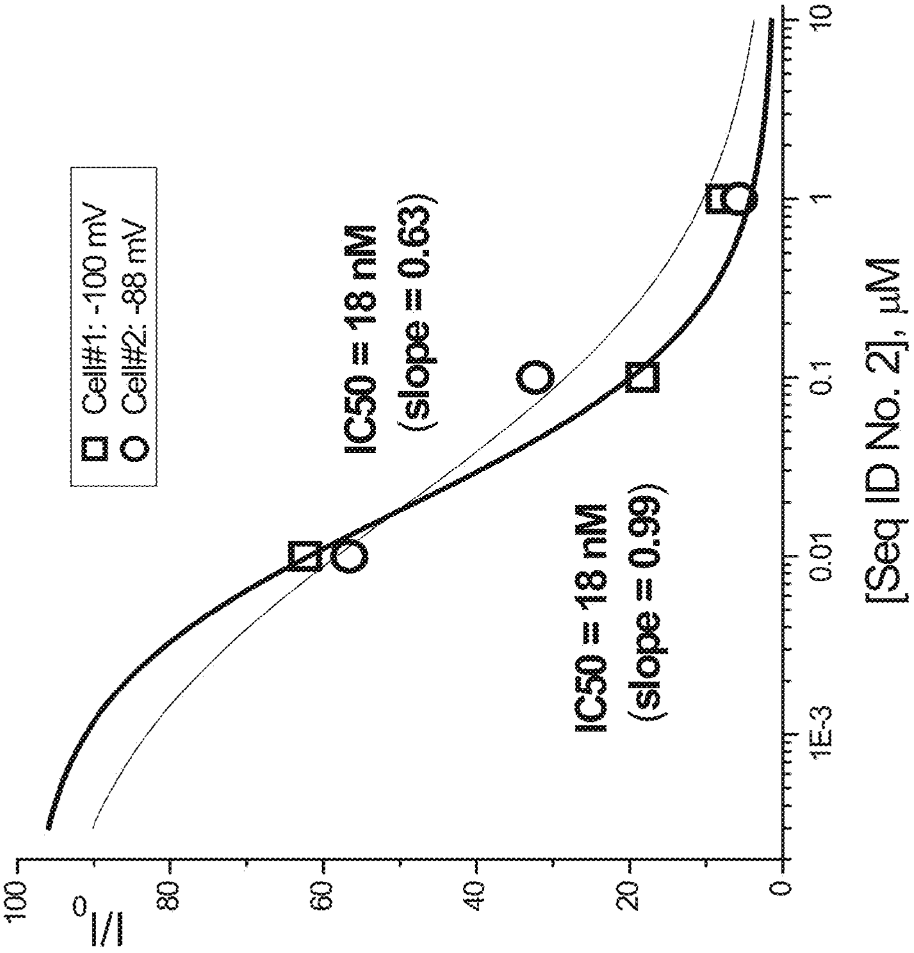
FIG. 30 shows the dose-response curves of JzTx-V(1-29) (SEQ ID NO:2) against TTX-sensitive Nav channels in two separate mouse DRG neurons. Peak inward Nav currents were measured at 0 mV in the presence of increasing concentrations of JzTx-V(1-29) (SEQ ID NO:2); cells were held at a voltage that yielded 20-25% inactivation.
Figure 31:
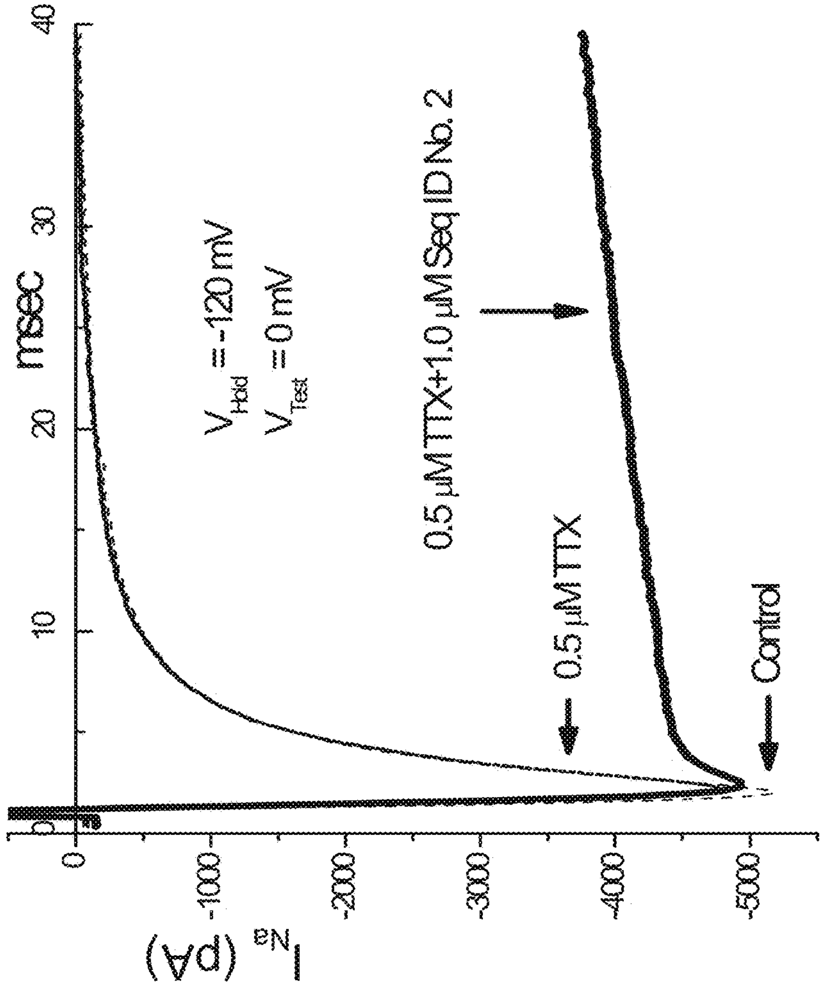
FIG. 31 shows the effect of JzTx-V(1-29) (SEQ ID NO:2) on TTX-resistant Nav channels in mouse DRG neuron. Cell was held at −120 mV and peak inward Nav currents were measured at 0 mV. "Control" trace shows Nav current before JzTx-V(1-29) (SEQ ID NO:2), "0.5 μM TTX" trace shows Nav current after TTX, and "0.5 μM TTX+1.0 μM Seq ID No. 2" trace shows Nav current after TTX and JzTx-V(1-29) (SEQ ID NO:2) addition. Note that JzTx-V(1-29) (SEQ ID NO:2) had nominal effect on peak TTX-resistant current but prolonged the level of TTX-resistant current at 40 msec. $IC_{50}$ was not measurable.
Figure 32:
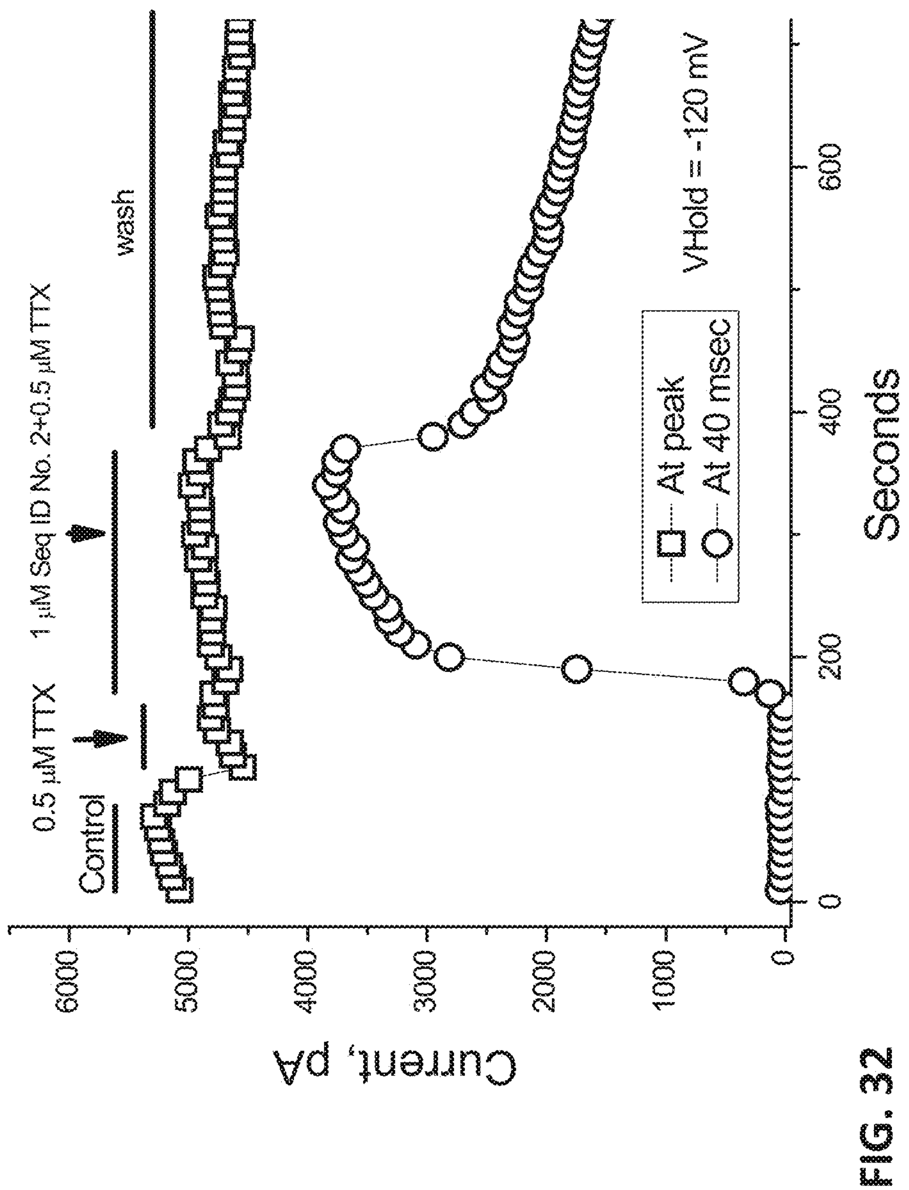
FIG. 32 shows the time course of 1 μM JzTx-V(1-29) (SEQ ID NO:2) against TTX-resistant Nav channels in mouse DRG neuron (fully non-inactivated state). Peak (squares) and sustained inward Nav currents at 40 msec (circles) were measured at 0 mV from a holding potential of −120 mV every 10 seconds. "Control" indicates Nav current in the absence of JzTx-V(1-29) (SEQ ID NO:2); "TTX" indicates Nav current in the presence of 0.5 μM TTX, "1 μM Seq ID No. 2+0.5 μM TTX" indicates Nav current in the presence of JzTx-V(1-29) (SEQ ID NO:2) and TTX, and "Wash" indicates Nav current following removal of JzTx-V(1-29) (SEQ ID NO:2) and TTX. Note that JzTx-V(1-29) (SEQ ID NO:2) had nominal effect on peak TTX-resistant current but prolonged the level of TTX-resistant current at 40 msec. $IC_{50}$ was not measurable.
Figure 33:
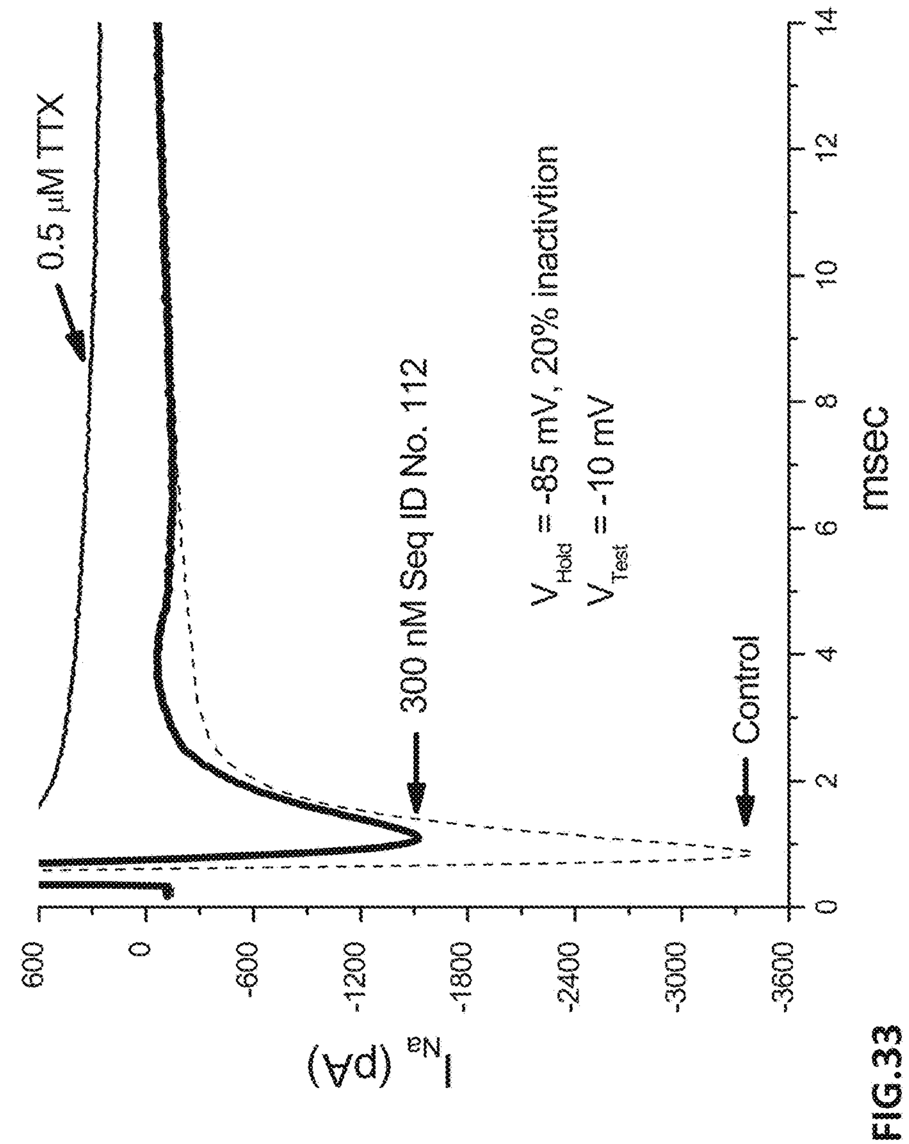
FIG. 33 shows the effect of [Glu20,Trp29]JzTx-V(1-29) (SEQ ID NO:112) on TTX-sensitive Nav channels in mouse DRG neuron cultured for 10 days. Cell was held at −85 mV and peak inward Nav currents were measured at −10 mV. "Control" trace shows Nav current before [Glu20,Trp29] JzTx-V(1-29) (SEQ ID NO:112), "300 nM Seq ID No. 112" trace shows Nav current after [Glu20,Trp29]JzTx-V(1-29) (SEQ ID NO:112) addition, and "0.5 μM TTX" trace shows Nav current after TTX addition. Note that 300 nM [Glu20, Trp29]JzTx-V(1-29) (SEQ ID NO:112) only blocked around half of TTX-sensitive Nav current.
Figure 34:
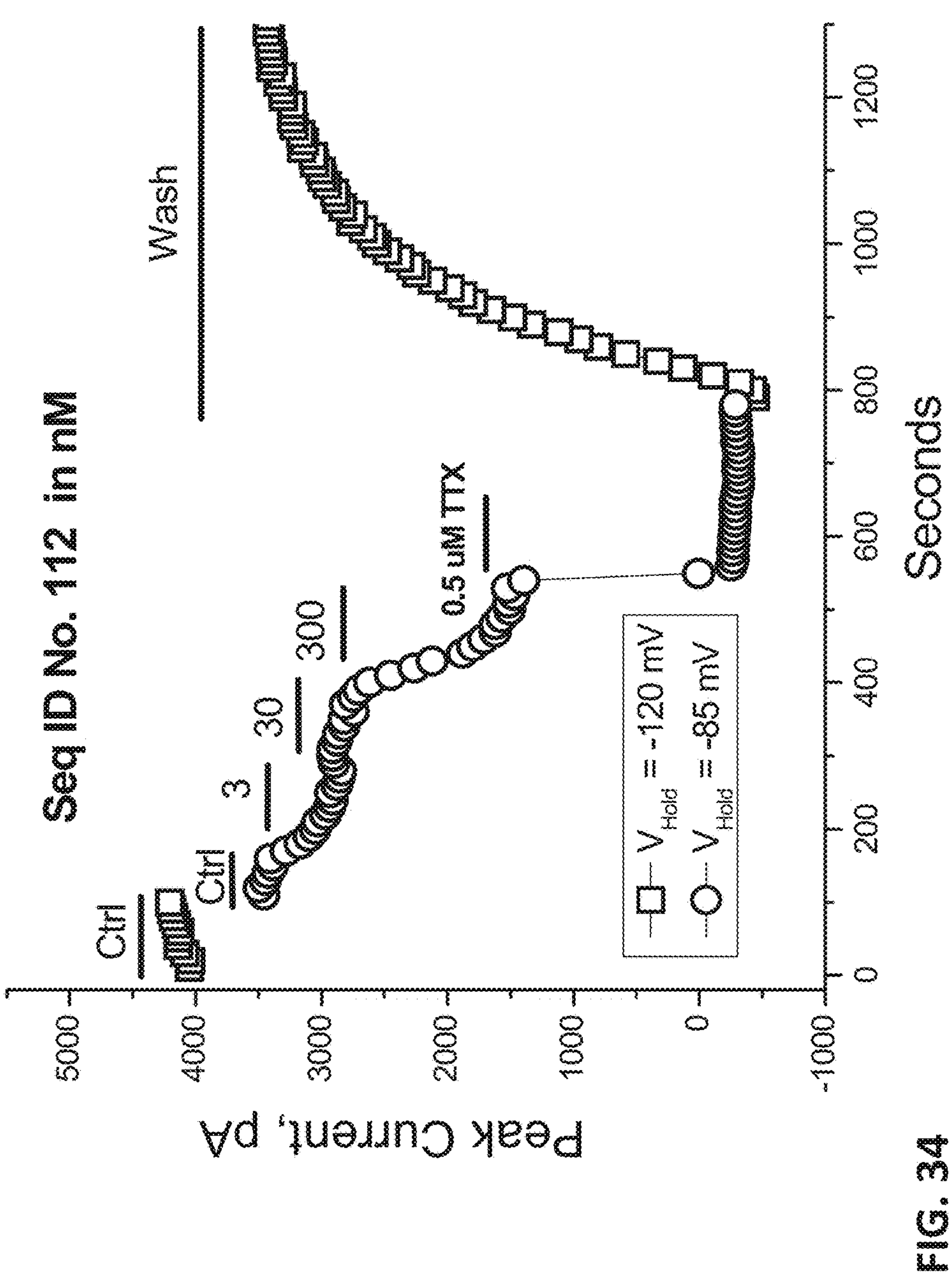
FIG. 34 shows the time course of increasing concentrations of [Glu20,Trp29]JzTx-V(1-29) (SEQ ID NO:112) against TTX-sensitive Nav channels in mouse DRG neuron cultured for 10 days. Peak inward Nav currents were measured at −10 mV every 10 seconds in the presence of increasing concentrations of [Glu20,Trp29]JzTx-V(1-29) (SEQ ID NO:112); cell was held at either −120 mV (squares), a voltage where Nav channels are completely non-inactivated, or −85 mV (circles), a voltage that yields approximately 20% inactivation. "Ctrl" indicates Nav current in the absence of [Glu20,Trp29]JzTx-V(1-29) (SEQ ID NO:112), "0.5 μM TTX" indicates Nav current in the presence of 0.5 μM TTX, and "Wash" indicates Nav current following removal of [Glu20,Trp29]JzTx-V(1-29) (SEQ ID NO:112) and TTX.
Figure 35:
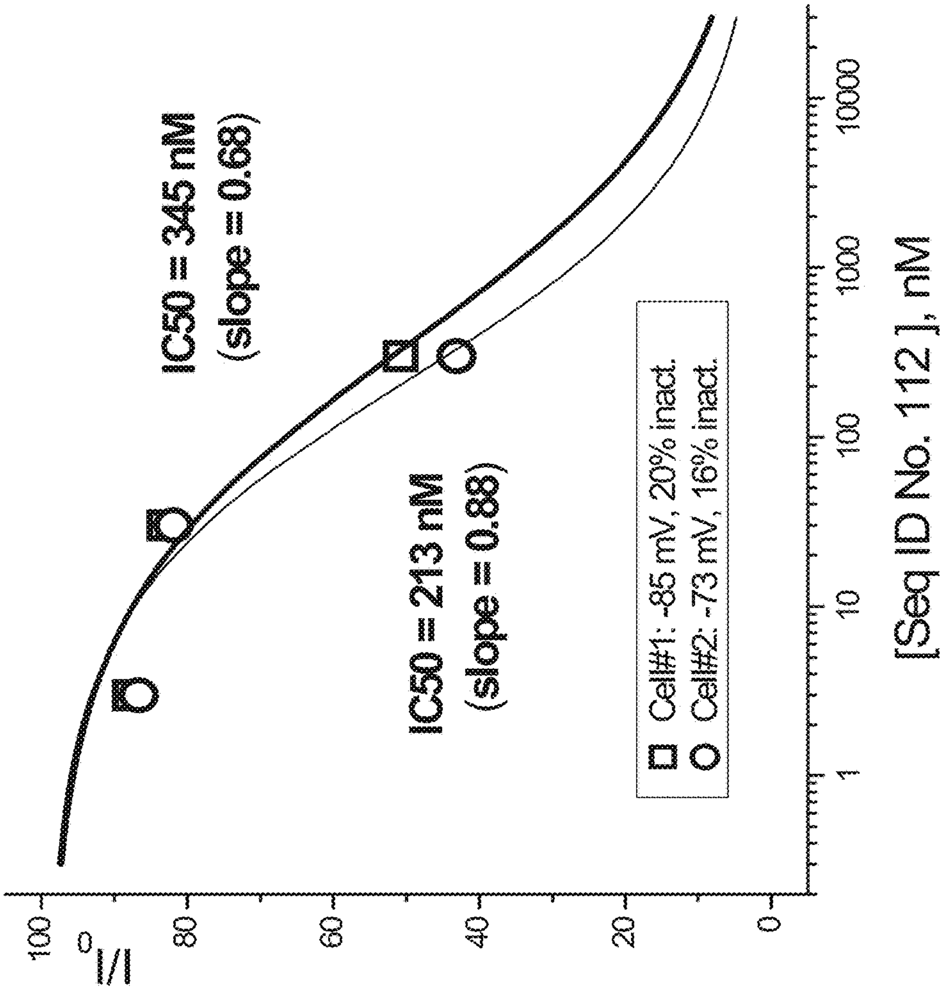
FIG. 35 shows the dose-response curves of [Glu20,Trp29] JzTx-V(1-29) (SEQ ID NO:112) against TTX-sensitive Nav channels in two separate mouse DRG neurons cultured for 10 days. Peak inward Nav currents were measured at −10 mV in the presence of increasing concentrations of [Glu20, Trp29]JzTx-V(1-29) (SEQ ID NO:112); cells were held at a voltage that yielded 20% inactivation.
Figure 36:
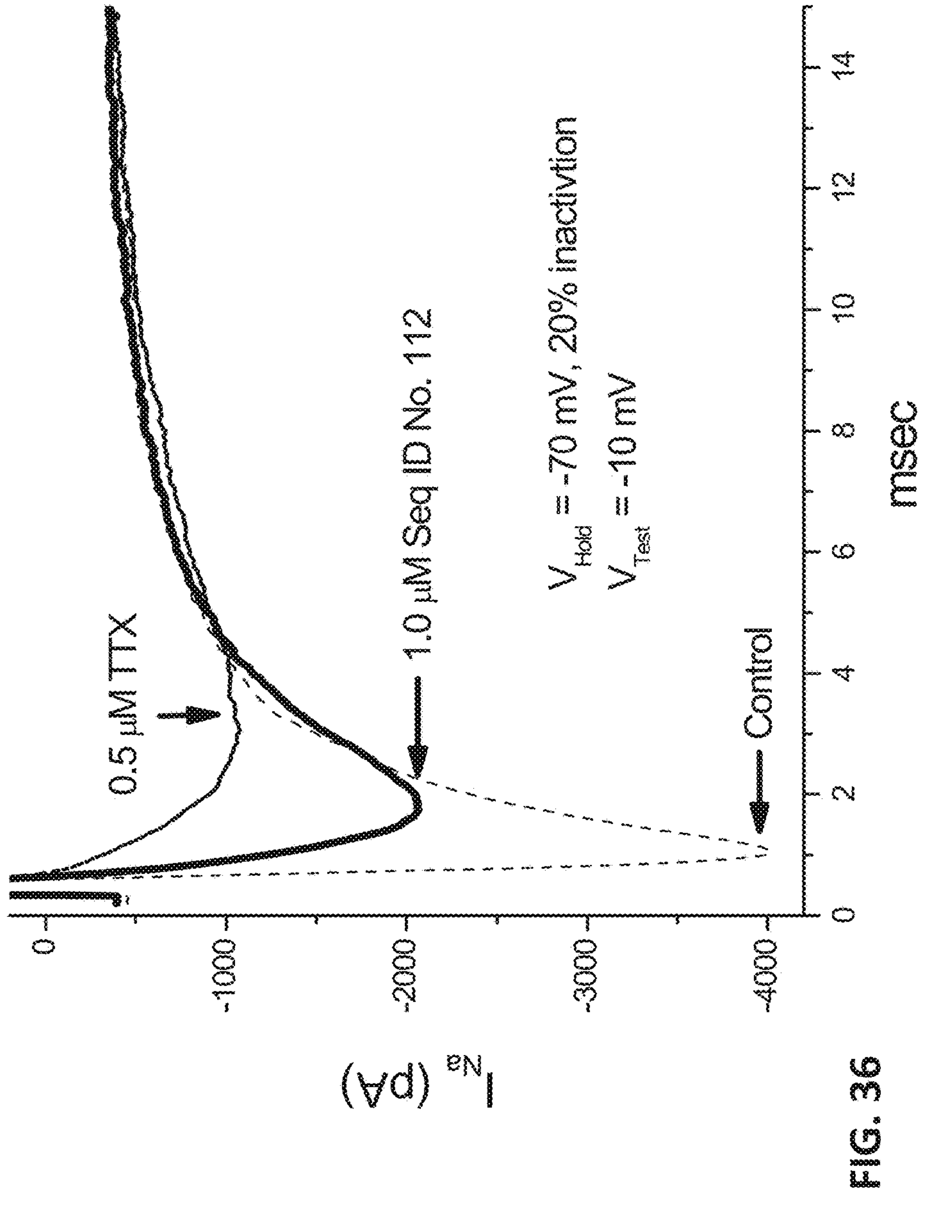
FIG. 36 shows the effect of [Glu20,Trp29]JzTx-V(1-29) (SEQ ID NO:112) on TTX-sensitive Nav channels in acutely isolated mouse DRG neuron. Cell was held at −70 mV and peak inward Nav currents were measured at −10 mV. "Control" trace shows Nav current before [Glu20,Trp29] JzTx-V(1-29) (SEQ ID NO:112), "1 μM Seq ID No. 112" trace shows Nav current after [Glu20,Trp29]JzTx-V(1-29) (SEQ ID NO:112) addition, and "0.5 μM TTX" trace shows Nav current after TTX addition. Note that 1 μM [Glu20, Trp29]JzTx-V(1-29) (SEQ ID NO:112) only partially blocked TTX-sensitive Nav current. Current that remained following 0.5 μM TTX is TTX-resistant current.
Figure 37:
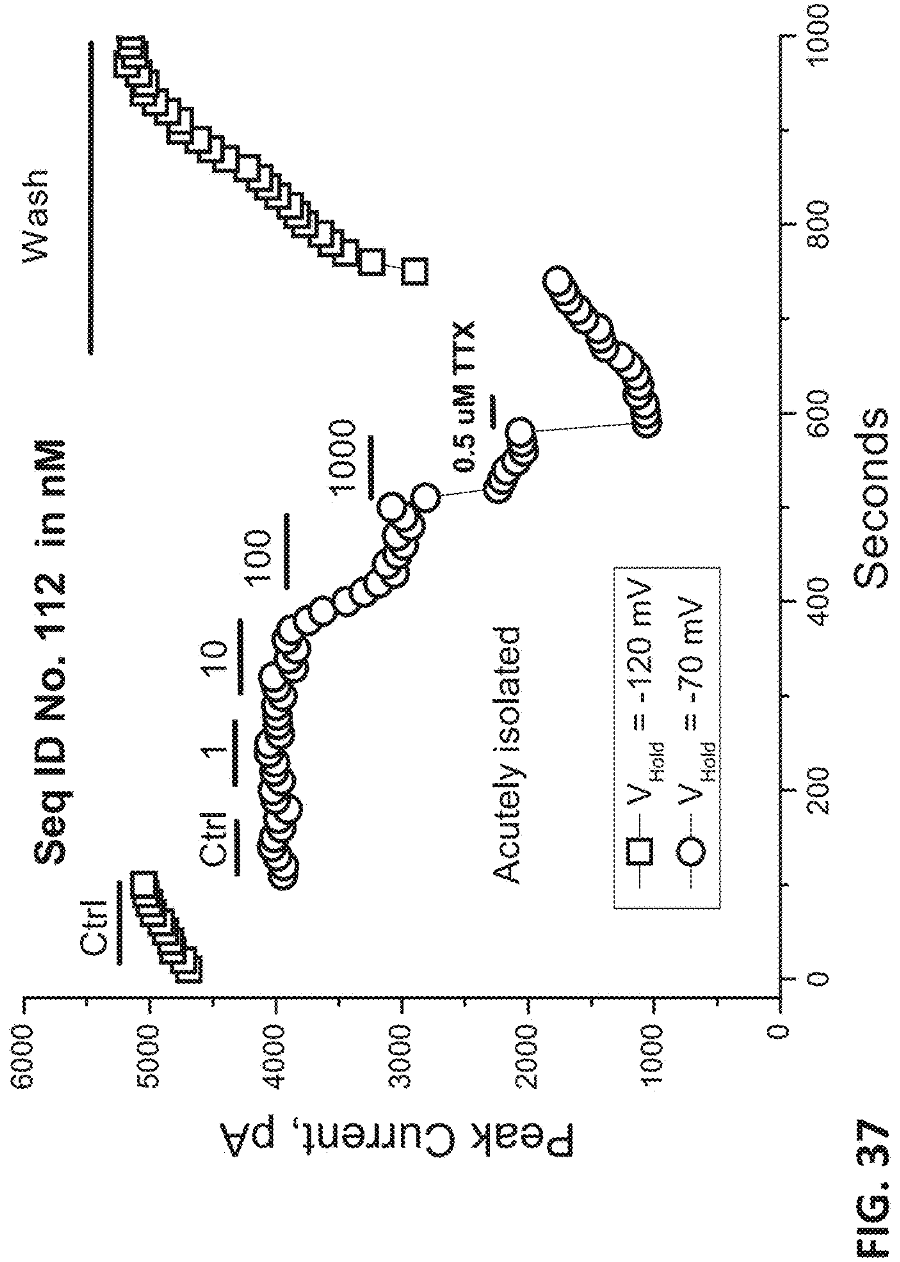
FIG. 37 shows the time course of increasing concentrations of [Glu20,Trp29]JzTx-V(1-29) (SEQ ID NO:112) against TTX-sensitive Nav channels in acutely isolated mouse DRG neuron. Peak inward Nav currents were measured at −10 mV every 10 seconds in the presence of increasing concentrations of [Glu20,Trp29]JzTx-V(1-29) (SEQ ID NO:112); cell was held at either −120 mV (squares), a voltage where Nav channels are completely non-inactivated, or −70 mV (circles), a voltage that yields approximately 20% inactivation. "Ctrl" indicates Nav current in the absence of [Glu20,Trp29]JzTx-V(1-29) (SEQ ID NO:112), "0.5 μM TTX" indicates Nav current in the presence of 0.5 μM TTX, and "Wash" indicates Nav current following removal of [Glu20,Trp29]JzTx-V(1-29) (SEQ ID NO:112) and TTX.
Figure 38:
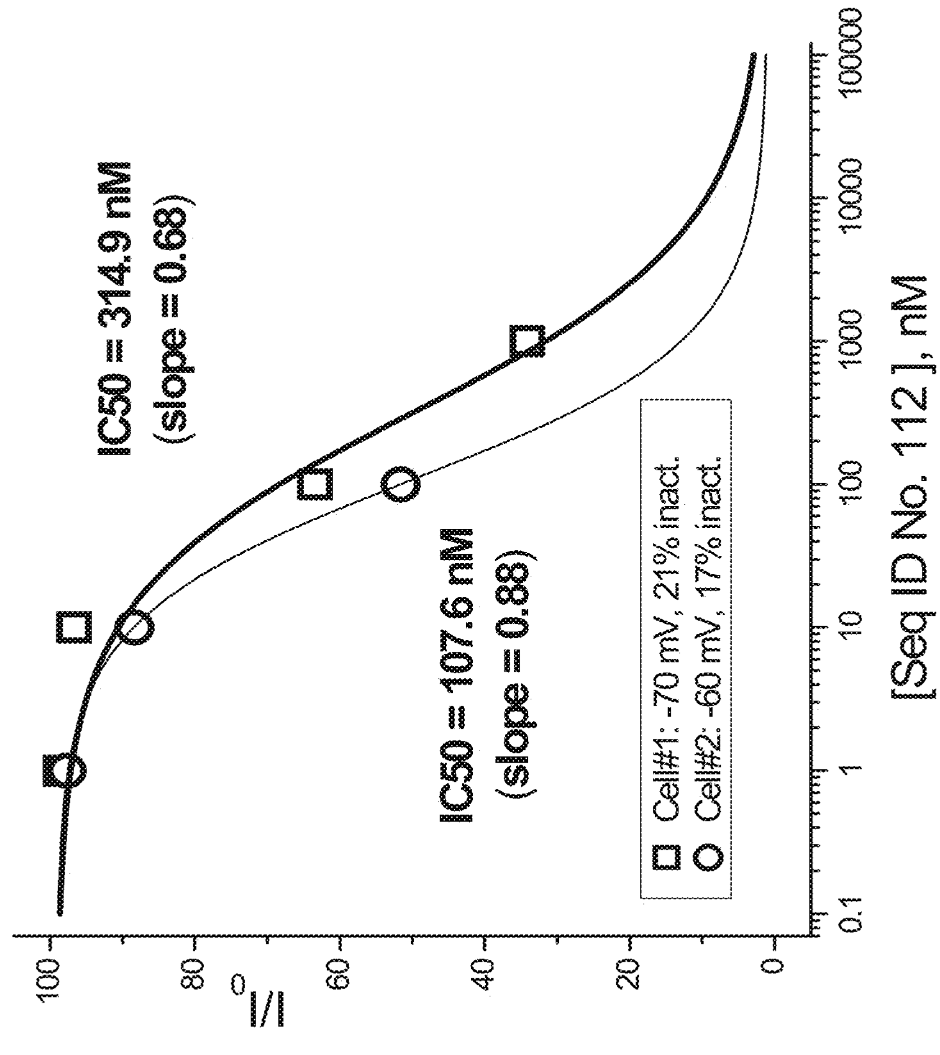
FIG. 38 shows the dose-response curves of [Glu20,Trp29] JzTx-V(1-29) (SEQ ID NO:112) against TTX-sensitive Nav channels in acutely isolated mouse DRG neuron. Peak inward Nav currents were measured at −10 mV in the presence of increasing concentrations of [Glu20,Trp29] JzTx-V(1-29) (SEQ ID NO:112); cells were held at a voltage that yielded 20% inactivation. TTX-sensitive currents were measured in reference to the current remaining after 0.5 μM TTX, which was taken as the zero point.
Figure 39:
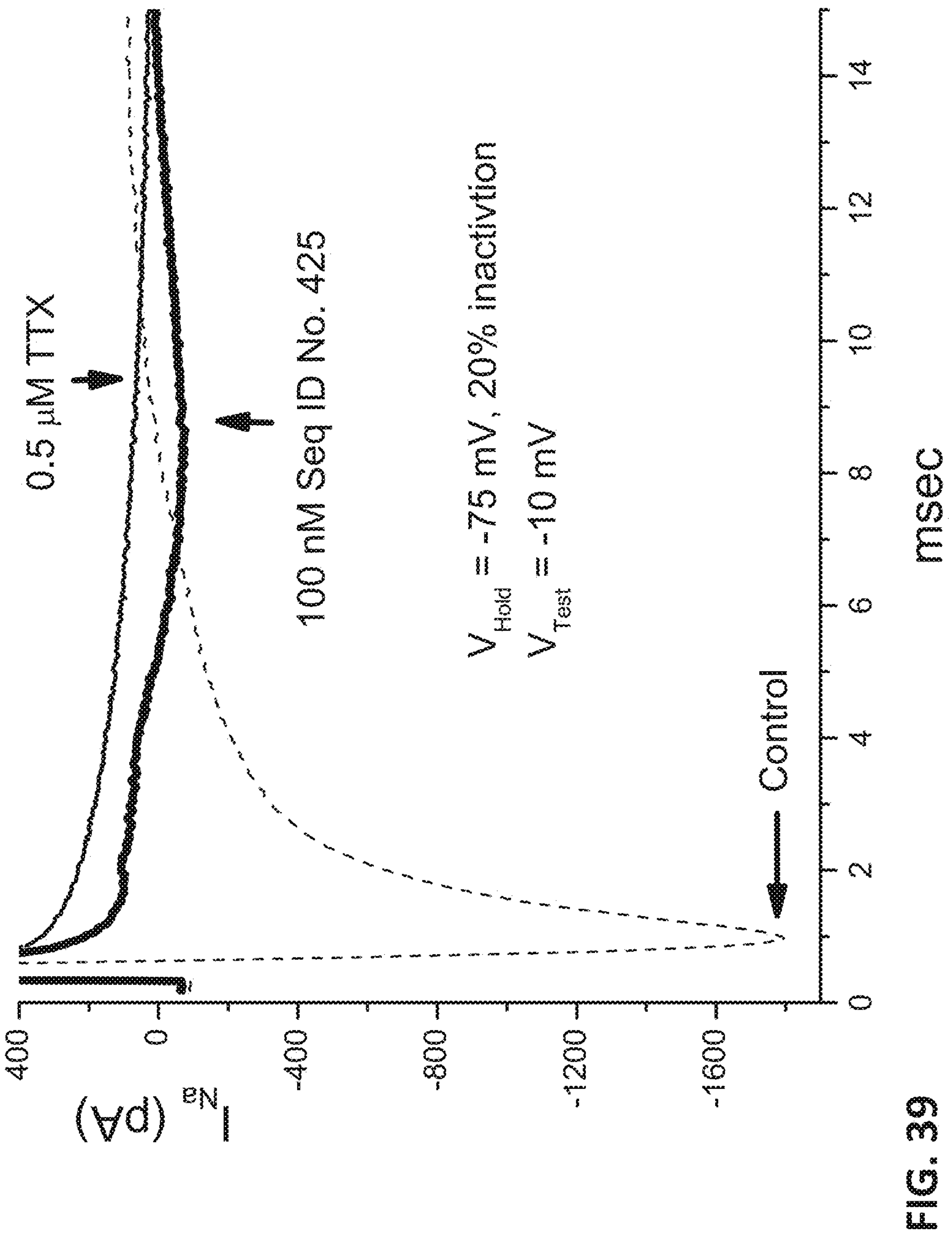
FIG. 39 shows the effect of Pra-[Nle6]JzTx-V(1-29) (SEQ ID NO:425) on TTX-sensitive Nav channels in mouse DRG neuron cultured for 10 days. Cell was held at −75 mV and peak inward Nav currents were measured at −10 mV. "Control" trace shows Nav current before Pra-[Nle6]JzTx-V(1-29) (SEQ ID NO:425), "100 nM Seq ID No. 425" trace shows Nav current after Pra-[Nle6]JzTx-V(1-29) (SEQ ID NO:425) addition, and "0.5 μM TTX" trace shows Nav current after TTX addition. Note that 100 nM Pra-[Nle6] JzTx-V(1-29) (SEQ ID NO:425) blocked most TTX-sensitive Nav current.
Figure 40:
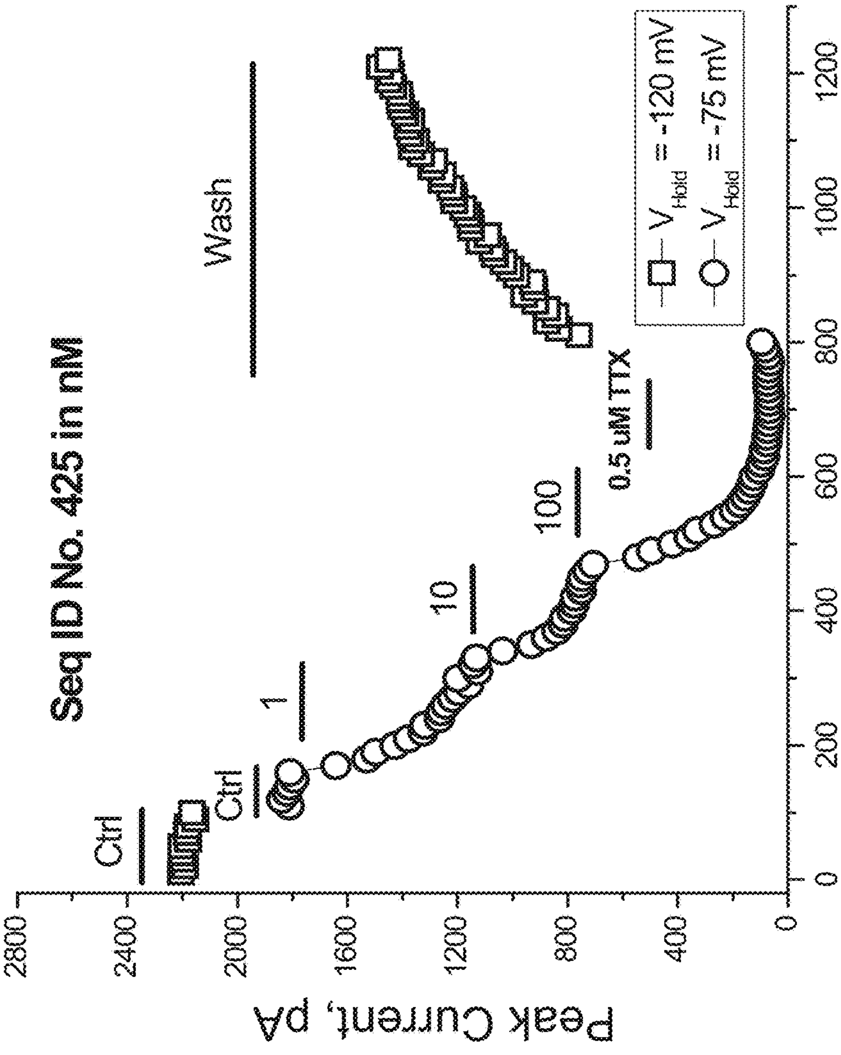
FIG. 40 shows the time course of increasing concentrations of Pra-[Nle6]JzTx-V(1-29) (SEQ ID NO:425) against TTX-sensitive Nav channels in mouse DRG neuron cultured for 10 days. Peak inward Nav currents were measured at −10 mV every 10 seconds in the presence of increasing concentrations of Pra-[Nle6]JzTx-V(1-29) (SEQ ID NO:425); cell was held at either −120 mV (squares), a voltage where Nav channels are completely non-inactivated, or −75 mV (circles), a voltage that yields approximately 20% inactivation. "Ctrl" indicates Nav current in the absence of Pra-[Nle6]JzTx-V(1-29) (SEQ ID NO:425), "0.5 μM TTX" indicates Nav current in the presence of 0.5 μM TTX, and "Wash" indicates Nav current following removal of Pra-[Nle6]JzTx-V(1-29) (SEQ ID NO:425) and TTX.
Figure 41:
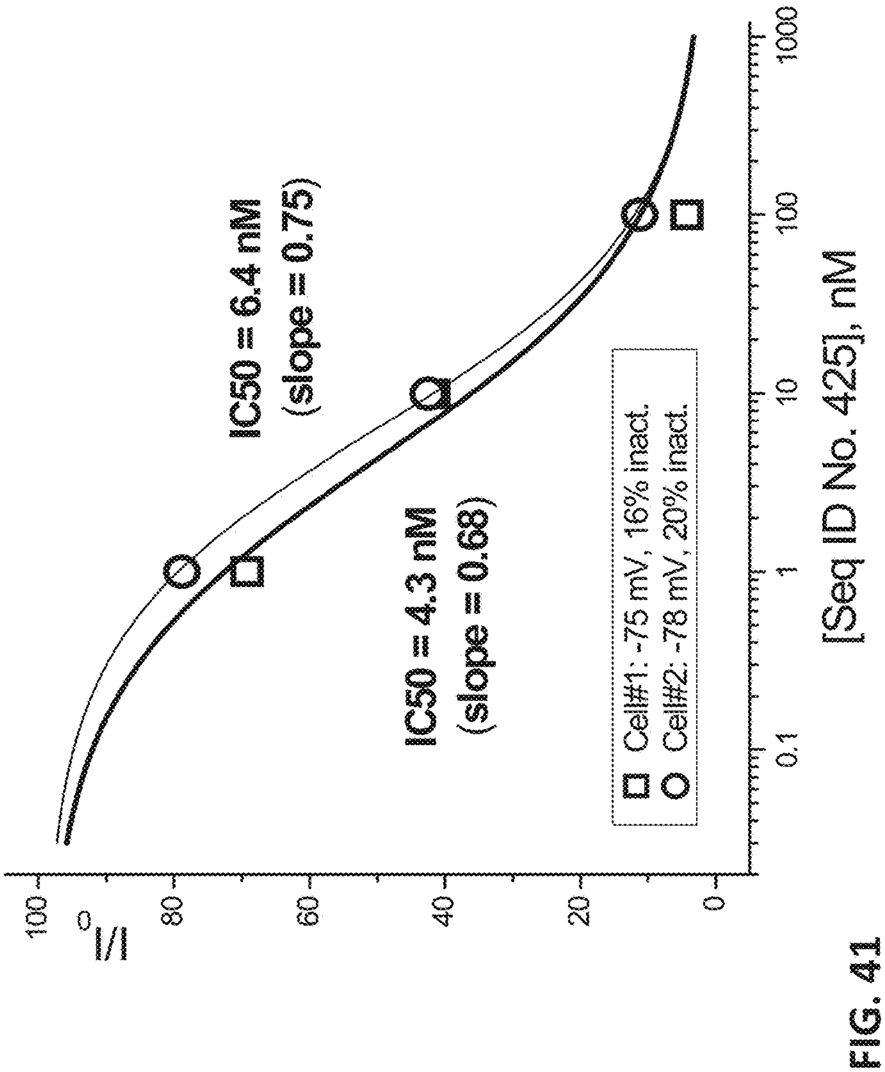
FIG. 41 shows the dose-response curves of Pra-[Nle6] JzTx-V(1-29) (SEQ ID NO:425) against TTX-sensitive Nav channels in two separate mouse DRG neurons cultured for 10 days. Peak inward Nav currents were measured at −10 mV in the presence of increasing concentrations of Pra-[Nle6]JzTx-V(1-29) (SEQ ID NO:425); cells were held at a voltage that yielded around 20% inactivation.
Figure 42:
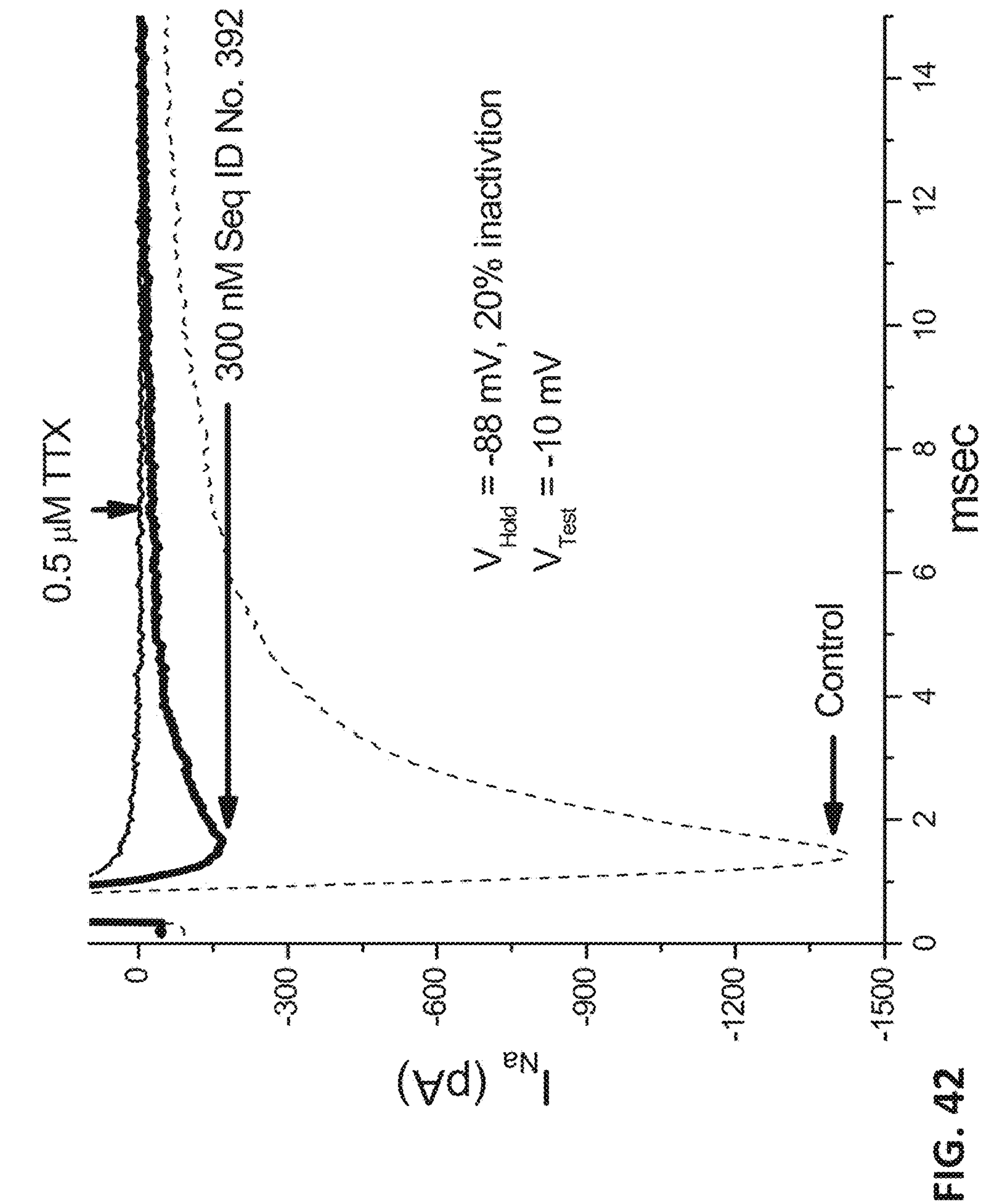
FIG. 42 shows the effect of CyA-[Nle6,Lys(Pra)14, Glu28]JzTx-V(1-29) (SEQ ID NO:392) on TTX-sensitive Nav channels in mouse DRG neuron. Cell was held at −88 mV and peak inward Nav currents were measured at −10 mV. "Control" trace shows Nav current before CyA-[Nle6, Lys(Pra)14,Glu28]JzTx-V(1-29) (SEQ ID NO:392), "300 nM Seq ID No. 392" trace shows Nav current after CyA-[Nle6,Lys(Pra)14,Glu28]JzTx-V(1-29) (SEQ ID NO:392) addition, and "0.5 μM TTX" trace shows Nav current after TTX addition. Note that 300 nM CyA-[Nle6,Lys(Pra)14, Glu28]JzTx-V(1-29) (SEQ ID NO:392) blocked most TTX-sensitive Nav current.
Figure 43:
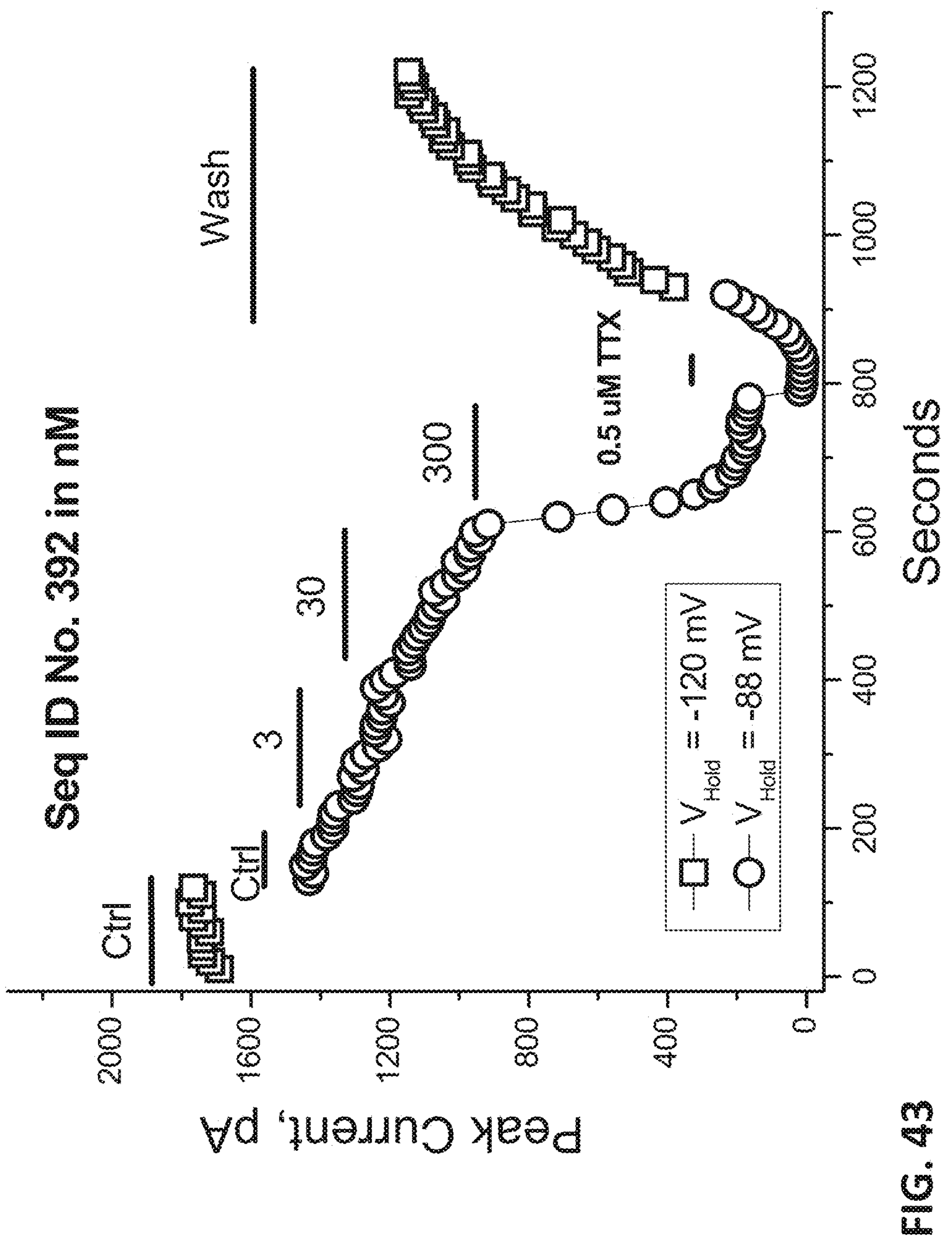
FIG. 43 shows the time course of increasing concentrations of CyA-[Nle6,Lys(Pra)14,Glu28]JzTx-V(1-29) (SEQ ID NO:392) against TTX-sensitive Nav channels in mouse DRG neuron. Peak inward Nav currents were measured at −10 mV every 10 seconds in the presence of increasing concentrations of CyA-[Nle6,Lys(Pra)14,Glu28]JzTx-V(1-29) (SEQ ID NO:392); cell was held at either −120 mV (squares), a voltage where Nav channels are completely non-inactivated, or −88 mV (circles), a voltage that yields approximately 20% inactivation. "Ctrl" indicates Nav current in the absence of CyA-[Nle6,Lys(Pra)14,Glu28]JzTx-V(1-29) (SEQ ID NO:392), "0.5 μM TTX" indicates Nav current in the presence of 0.5 μM TTX, and "Wash" indicates Nav current following removal of CyA-[Nle6,Lys(Pra) 14,Glu28]JzTx-V(1-29) (SEQ ID NO:392) and TTX.
Figure 44:
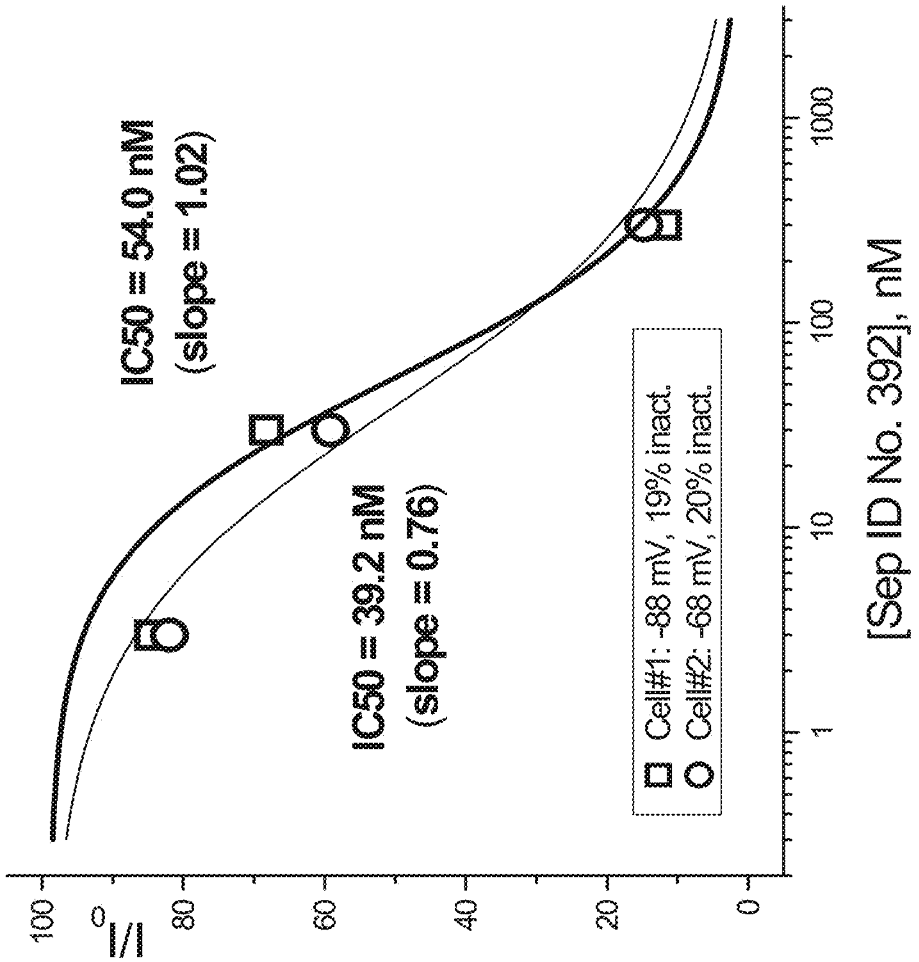
FIG. 44 shows the dose-response curves of CyA-[Nle6, Lys(Pra)14,Glu28]JzTx-V(1-29) (SEQ ID NO:392) against TTX-sensitive Nav channels in two separate mouse DRG neurons. Peak inward Nav currents were measured at −10 mV in the presence of increasing concentrations of CyA-[Nle6,Lys(Pra)14,Glu28]JzTx-V(1-29) (SEQ ID NO:392); cells were held at a voltage that yielded around 20% inactivation.
Figure 45:
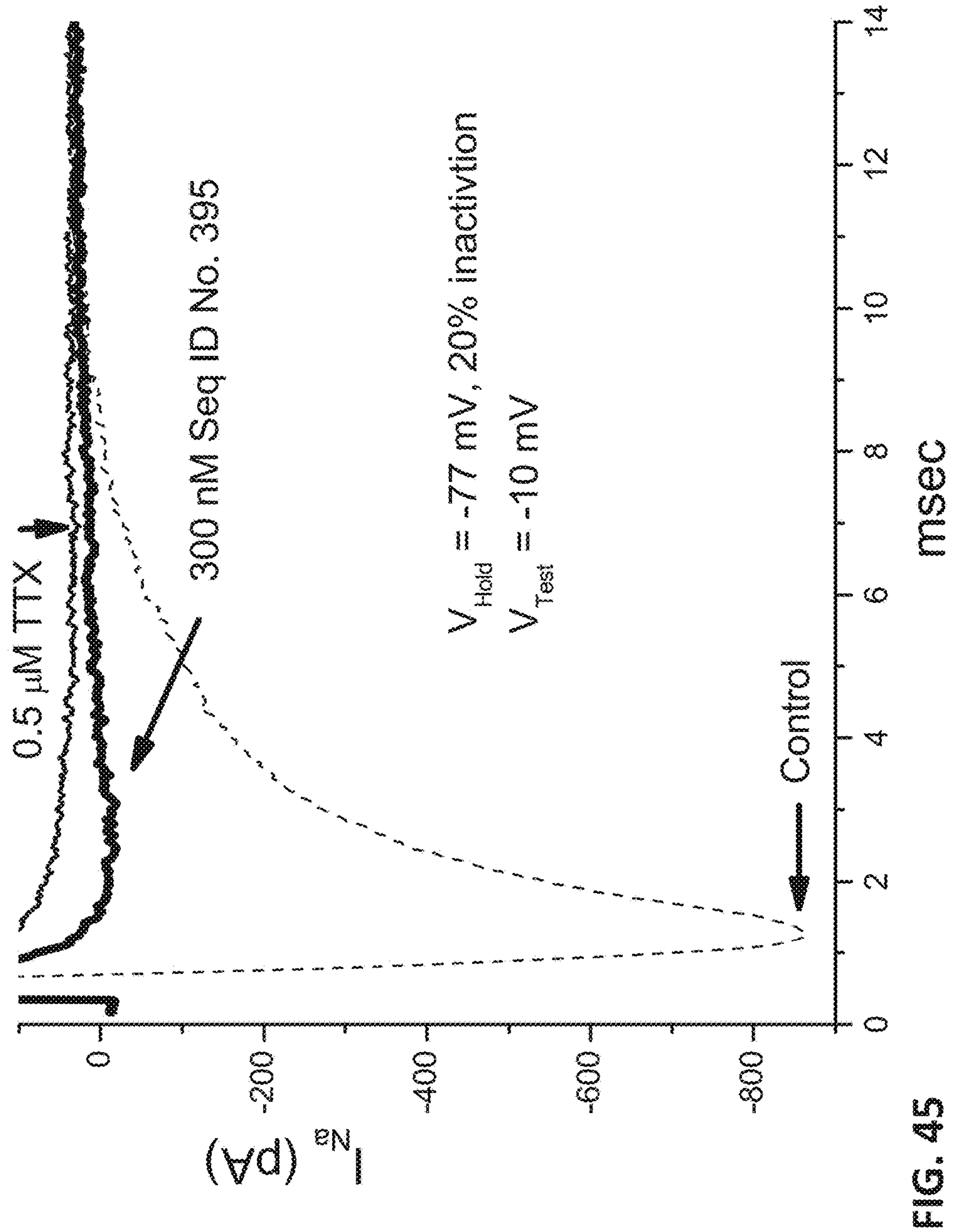
FIG. 45 shows the effect of CyA-[Nle6, Pra17, Glu28] JzTx-V(1-29) (SEQ ID NO:395) on TTX-sensitive Nav channels in mouse DRG neuron. Cell was held at −77 mV and peak inward Nav currents were measured at −10 mV. "Control" trace shows Nav current before CyA-[Nle6,Pra17, Glu28]JzTx-V(1-29) (SEQ ID NO:395), '300 nM Seq ID No. 395' trace shows Nav current after CyA-[Nle6,Pra17, Glu28]JzTx-V(1-29) (SEQ ID NO:395) addition, and "0.5 nM TTX" trace shows Nav current after TTX addition. Note that 300 nM CyA-[Nle6,Pra17,Glu28]JzTx-V(1-29) (SEQ ID NO:395) fully blocked TTX-sensitive Nav current.
Figure 46:
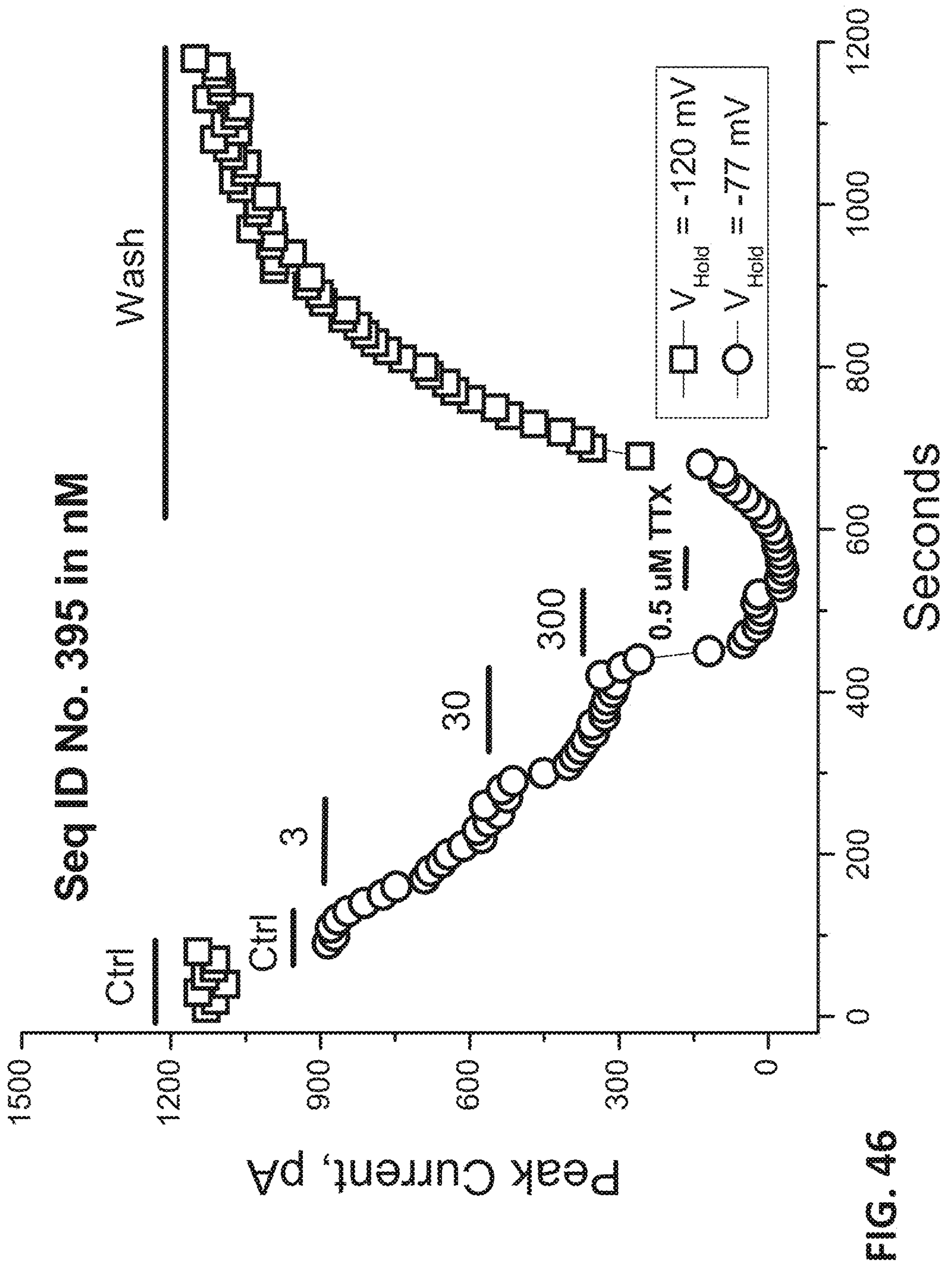
FIG. 46 shows the time course of increasing concentrations of CyA-[Nle6,Pra17,Glu28]JzTx-V(1-29) (SEQ ID NO:395) against TTX-sensitive Nav channels in mouse DRG neuron. Peak inward Nav currents were measured at −10 mV every 10 seconds in the presence of increasing concentrations of CyA-[Nle6,Pra17,Glu28]JzTx-V(1-29) (SEQ ID NO:395); cell was held at either −120 mV (squares), a voltage where Nav channels are completely non-inactivated, or −77 mV (circles), a voltage that yields approximately 20% inactivation. "Ctrl" indicates Nav current in the absence of CyA-[Nle6,Pra17,Glu28]JzTx-V(1-29) (SEQ ID NO:395), "0.5 μM TTX" indicates Nav current in the presence of 0.5 μM TTX, and "Wash" indicates Nav current following removal of CyA-[Nle6,Pra17,Glu28] JzTx-V(1-29) (SEQ ID NO:395) and TTX.
Figure 47:
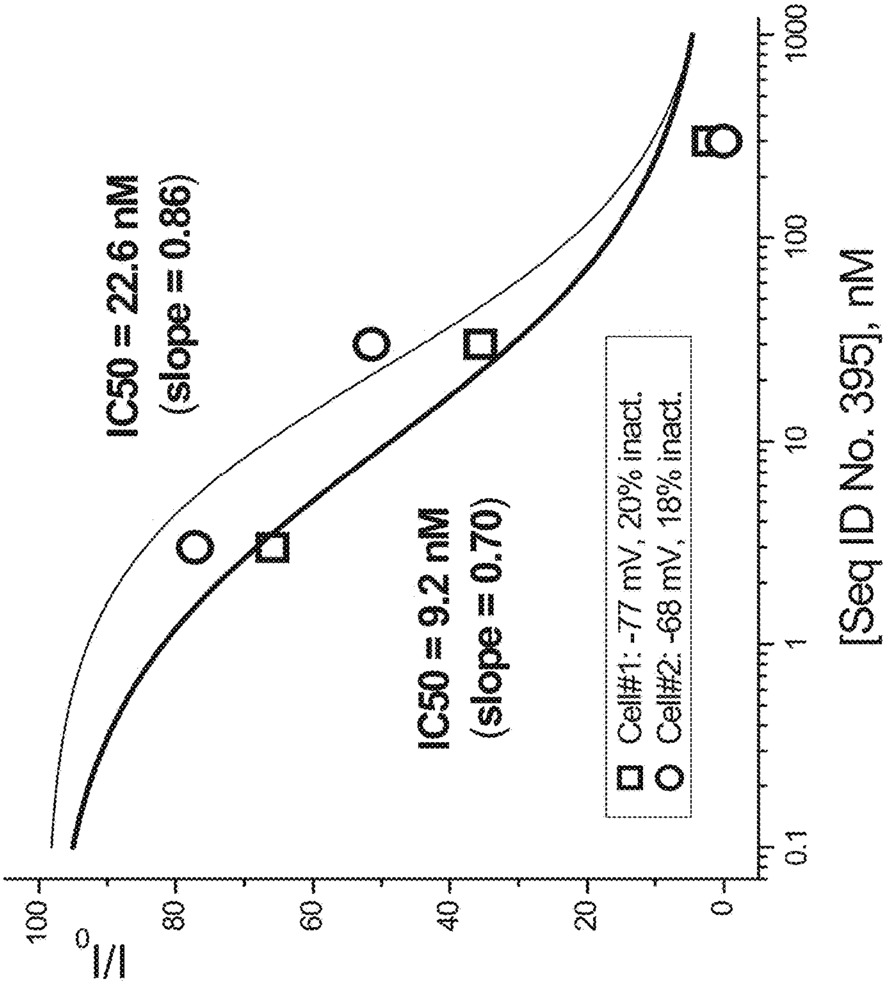
FIG. 47 shows the dose-response curves of CyA-[Nle6, Pra17,Glu28]JzTx-V(1-29) (SEQ ID NO:395) against TTX-sensitive Nav channels in two separate mouse DRG neurons. Peak inward Nav currents were measured at −10 mV in the presence of increasing concentrations of CyA-[Nle6,Pra17, Glu28]JzTx-V(1-29) (SEQ ID NO:395); cells were held at a voltage that yielded around 20% inactivation.

Manual patch clamp electrophysiology was performed on JzTx-V(1-29) (SEQ ID NO:2), [Glu20,Trp29]JzTx-V(1-29) (SEQ ID NO:112), Pra-[Nle6]JzTx-V(1-29) (SEQ ID NO:425), CyA-[Nle6,Lys(Pra)14,Glu28]JzTx-V (SEQ ID NO:392), CyA-[Nle6,Pra17,Glu28]JzTx-V (SEQ ID NO:395), Pra-[Nle6,Glu28]JzTx-V(1-29) (SEQ ID NO:328), CyA-[Nle6,Atz(NPEG10)17,Glu28]JzTx-V(1-29) (SEQ ID NO:443), Pra-[Nle6; Glu12,28]JzTx-V(1-29) (SEQ ID NO:715), Pra-[Nle6; Glu14,28]JzTx-V(1-29) (SEQ ID NO:717), and Pra-[Nle6,5-BrW24,Glu28]JzTx-V (1-29) (SEQ ID NO:858) on isolated mouse DRG neurons. (See Table 14.) Testing with 1 μM JzTx-V showed almost complete inhibition of the TTX-sensitive sodium current in mouse DRG neurons. (See, FIG. 28). The effects of JzTx-V addition in increasing concentrations and wash out on TTX-sensitive sodium channel current in mouse DRG neurons were recorded. (See FIG. 29). The $IC_{50}$ value of TTX-sensitive sodium channel current inhibition for JzTx-V was 18 nM. (See FIG. 30). Testing of 1 μM JzTx-V with 0.5 μM TTX showed only partial inhibition of the TTX-resistant sodium current in mouse DRG neurons. (See, FIG. 31). The effects of JzTx-V addition in increasing concentrations and wash out on TTX-resistant sodium channel current in mouse DRG neurons were recorded. (See FIG. 32). The $IC_{50}$ value of TTX-resistant sodium channel current inhibition for JzTx-V was not measurable. Testing with 300 nM [Glu20,Trp29]JzTx-V(1-29) showed only partial inhibition of the TTX-sensitive sodium current in cultured (10 days) mouse DRG neurons. (See, FIG. 33). The effects of [Glu20,Trp29]JzTx-V(1-29) addition in increasing concentrations and wash out on TTX-sensitive sodium channel current in cultured mouse DRG neurons (10 days) were recorded. (See FIG. 34). The $IC_{50}$ value of TTX-sensitive sodium channel current inhibition in cultured DRG neurons (10 days) for [Glu20,Trp29]JzTx-V(1-29) was 279 nM. (See FIG. 35). Testing with 1 μM [Glu20,Trp29]JzTx-V(1-29) showed only partial inhibition of the TTX-sensitive sodium current in acutely isolated mouse DRG neurons. (See, FIG. 36). The effects of [Glu20,Trp29]JzTx-V(1-29) addition in increasing concentrations and wash out on TTX-sensitive sodium channel current in acutely isolated mouse DRG neurons were recorded. (See FIG. 37). The $IC_{50}$ value of TTX-sensitive sodium channel current inhibition in acutely isolated DRG neurons for [Glu20,Trp29]JzTx-V(1-29) was 211 nM. (See FIG. 38). Testing with 1 nM Pra-[Nle6]JzTx-V(1-29) showed almost complete inhibition of the TTX-sensitive sodium current in mouse DRG neurons. (See, FIG. 39). The effects of Pra-[Nle6]JzTx-V(1-29) addition in increasing concentrations and wash out on TTX-sensitive sodium channel current in mouse DRG neurons were recorded. (See FIG. 40). The $IC_{50}$ value of TTX-sensitive sodium channel current inhibition with a holding voltage yielding 20% inactivation for Pra-[Nle6]JzTx-V(1-29) was 5.35 nM. (See FIG. 41). Testing with 300 nM CyA-[Nle6,Lys(Pra)14,Glu28]JzTx-V(1-29) showed almost complete inhibition of the TTX-sensitive sodium current in mouse DRG neurons. (See, FIG. 42). The effects of CyA-[Nle6,Lys(Pra)14,Glu28]JzTx-V(1-29) addition in increasing concentrations and wash out on TTX-sensitive sodium channel current in mouse DRG neurons were recorded. (See FIG. 43). The $IC_{50}$ value of TTX-sensitive sodium channel current inhibition with a holding voltage yielding 20% inactivation for CyA-[Nle6,Lys(Pra)14,Glu28]JzTx-V(1-29) was 46.6 nM. (See FIG. 44). Testing with 300 nM CyA-[Nle6,Pra17,Glu28]JzTx-V (1-29) showed complete inhibition of the TTX-sensitive sodium current in mouse DRG neurons. (See, FIG. 45). The effects of CyA-[Nle6,Pra17,Glu28]JzTx-V(1-29) addition in increasing concentrations and wash out on TTX-sensitive sodium channel current in mouse DRG neurons were recorded. (See FIG. 46). The $IC_{50}$ value of TTX-sensitive sodium channel current inhibition with a holding voltage yielding 20% inactivation for CyA-[Nle6,Pra17,Glu28]JzTx-V(1-29) was 15.9 nM. (See FIG. 47). These results show that JzTx-V(1-29) is a potent inhibitor of TTX-sensitive but not TTX-resistant sodium channel current in mouse DRG neurons. [Glu20,Trp29]JzTx-V(1-29) is a much less potent inhibitor of TTX-sensitive sodium channel current in mouse DRG neurons than the wild type peptide with a nearly 1000-fold loss in potency relative to the human clone of Nav1.7. Pra-[Nle6]JzTx-V(1-29) is about 3-fold more potent than JzTx-V in the inhibition of TTX-sensitive sodium channel current in mouse DRG neurons. CyA-[Nle6,Pra17,Glu28]JzTx-V(1-29) is equipotent with the wild type peptide in the inhibition of TTX-sensitive sodium channel current in mouse DRG neurons. CyA-[Nle6,Lys(Pra)14,Glu28]JzTx-V(1-29) is about 3-fold less potent than JzTx-V in the inhibition of TTX-sensitive sodium channel current in mouse DRG neurons. Manual patch clamp electrophysiology was performed on a variety of other compounds on isolated mouse DRG neurons, including CyA-[Nle6,Pra17,Glu28]JzTx-V (SEQ ID NO:395), Pra-[Nle6,Glu28]JzTx-V (1-29) (SEQ ID NO:328), CyA-[Nle6,Atz(NPEG10)17,Glu28]JzTx-V (SEQ ID NO:443), Pra-[Nle6,Glu12,28]JzTx-V(1-29) (SEQ ID NO:715), Pra-[Nle6,Glu14,28]JzTx-V(1-29) (SEQ ID NO:717), Pra-[Nle6,5-BrW24,Glu28]JzTx-V(1-29) (SEQ ID NO:858), and Immunglobulin Peptide Conjugates 3, 5, 7, and 8. (See FIGS. 99-102, 129-131, 135-155, and 172-175 and Table 14). These results confirm that Pra-[Nle6; 5-BrW24; Glu28]JzTx-V(1-29)

(SEQ ID NO:858) is a single digit-nanomolar inhibitor of TTX-S current in mDRG neurons.

Manual patch clamp electrophysiology was performed on [Glu20,Trp29]JzTx-V(1-29) (SEQ ID NO:112), CyA-[Nle6, Pra17,Glu28]JzTx-V (SEQ ID NO:395), and Pra-[Nle6, Glu28]JzTx-V(1-29) (SEQ ID NO:328) on isolated rat DRG neurons. (See FIGS. 126-128 and 132-134). The $IC_{50}$ value of TTX-sensitive sodium channel current inhibition in acutely isolated rat DRG neurons for [Glu20,Trp29]JzTx-V (1-29) was 261 nM. These results were similar to those obtained with mouse DRG neurons for this compound. Other analogs were more potent inhibitors of TTX-S current in rat DRG neurons. The $IC_{50}$ value of TTX-sensitive sodium channel current inhibition in acutely isolated rat DRG neurons for CyA-[Nle6,Glu28]JzTx-V(1-29) was 9.25 nM. The $IC_{50}$ value of TTX-sensitive sodium channel current inhibition in acutely isolated rat DRG neurons for Pra-[Nle6,Glu28]JzTx-V(1-29) was 30.7 nM.

JzTx-V peptide analog Pra-[Nle6,Glu28]JzTx-V(1-29) (SEQ ID NO:328) was profiled by manual patch clamp electrophysiology on hNav1.1 (IC50=27.2 nM), hNav1.2 (IC50=44.4 nM), hNav1.3 (IC50=52.51 nM), hNav1.4 (IC50=74.6 nM), hNav1.5 (IC50=>1000 nM), hNav1.6 (IC50=19.45 nM), hNav1.7 (IC50=0.62 nM), and hNav1.8 (IC50=>1000 nM). These results demonstrate that Pra-[Nle6,Glu28]JzTx-V(1-29) is a potent inhibitor of hNav1.7 with >30-fold selectivity against other human VGSCs. Another peptide analog with good potency in the hNav1.7 PX assay was found to also be potent in the manual patch clamp hNav1.7 assay; Pra-[Nle6; 5-BrW24; Glu28]JzTx-V (SEQ ID NO:858) had an IC50 value of 0.130 nM.

A subset of Nav1.7 inhibitory peptides was profiled against hNav1.6 using the PATCHXPRESS® electrophysiology platform. (See Table 15). Potent Nav1.7 inhibitory peptide Pra-[Nle6]JzTx-V(1-29) (SEQ ID NO:425) was also found to be quite potent against hNav1.6 with an IC50 value of 68 nM. Incorporation of a glutamic acid residue at position 20 or 28 greatly increased the selectivity by reducing the activity against Nav1.6, similar to what had be observed previously for Nav1.4. This is exemplified by [Glu20,Trp29]JzTx-V(1-29) (SEQ ID NO:112) and [Glu28] JzTx-V(1-29) having IC50 values of 720 and 248 nM against Nav1.6 and being 454- and 437-fold selective for Nav1.7 over Nav1.6, respectively. The Glu28 modification was effective at increasing Nav1.6 selectivity in combination with a variety of other amino acid substitutions at different positions in the JzTx-V peptide scaffold. For example, Pra-[Nle6,Glu28]JzTx-V(1-29) (SEQ ID NO:328) was 334-fold selective against Nav1.6. Combination of a glutamic acid at position 28 with another glutamic acid substitution at the N-terminus, position 11, 12, or 14 resulted in a further reduction in Nav1.6 potency with a concomitant increase in selectivity to >500-fold. Some compounds with increased Nav1.7 potency, including Pra-[Nle6; 5-BrW24; Glu28]JzTx-V(1-29) (SEQ ID NO:858) and Pra-[hPhe5; Nle6; Glu28]JzTx-V(1-29) (SEQ 1D NO:844), also exhibited a higher level of Nav1.6 selectivity.

A set of Nav1.7 inhibitory peptides was profiled against the rodent Nav clones rat Nav1.7, mouse Nav1.7, and mouse Nav1.4 using the PATCHXPRESS® electrophysiology platform in order to correlate activities across different species. (See Table 16). A very small shift (<2-fold) was observed for human vs. rat Nav1.7 potencies. In general, a slightly larger shift was observed for human vs. mouse potencies, with some compounds being >10-fold less potent against mNav1.7 than hNav1.7, though some compounds did exhibit single-digit nanomolar and even subnanomolar potencies against mNav1.7. The slight reduction in mNav1.7 potencies also reduced the selectivity against mNav1.4, with most compounds being between 10- and 30-fold selective for mNav1.7 over mNav1.4.

TABLE 6

Electrophysiology by IonWorks ® Quattro: comparison of JzTx-V (SEQ ID NO: 2) and single substitution JzTx-V peptide analogs.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 1 | JzTx-V(1-29)-FreeAcid | YC1QKWMWTC2DSKRAC3C1EGLR C2KLWC3RKII{Amide} | 0.17 | >5 | 0.61 | 0.78 | 4 |
| 2 | JzTx-V(1-29) | YC1QKWMWTC2DSKRAC3C1EGLR C2KLWC3RKII{Amide} | 0.005 | 3.0 | 0.09 | 0.08 | 17 |
| 2 | JzTx-V(1-29) | YC1QKWMWTC2DSKRAC3C1EGLR C2KLWC3RKII{Amide} | 0.006 | 3.5 | 0.12 | 0.10 | 20 |
| 3 | [Ala1]JzTx-V(1-29) | AC1QKWMWTC2DSKRAC3C1EGLR C2KLWC3RKII{Amide} | 0.004 | 3.1 | 0.07 | 0.04 | 18 |
| 25 | [1-Nal]pzTx-V(1-29) | [1-Nal]C1QKWMWTC2DSKRAC3 C1EGLRC2KLWC3RKII{Amide} | 0.008 | 2.3 | 0.09 | 0.07 | 10 |
| 49 | [Glu1]JzTx-V(1-29) | EC1QKWMWTC2DSKRAC3C1EGLR C2KLWC3RKII{Amide} | 0.018 | >5.0 | 0.23 | 0.16 | 13 |
| 71 | [Lys1]JzTx-V(1-29) | KC1QKWMWTC2DSKRAC3C1EGLR C2KLWC3RKII{Amide} | 0.005 | 2.3 | 0.06 | 0.05 | 12 |
| 90 | [Arg1]JzTx-V(1-29) | RC1QKWMWTC2DSKRAC3C1EGLR C2KLWC3RKII{Amide} | 0.005 | 1.8 | 0.12 | 0.04 | 24 |
| 91 | [Arg3]JzTx-V(1-29) | YC1RKWMWTC2DSKRAC3C1EGLR C2KLWC3RKII{Amide} | 0.025 | 3.2 | 0.14 | 0.06 | 6 |

TABLE 6-continued

Electrophysiology by IonWorks ® Quattro: comparison of JzTx-V (SEQ ID NO: 2) and single substitution JzTx-V peptide analogs.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 92 | [Arg4]JzTx-V(1-29) | YC1QRWMWTC2DSKRAC3C1EGLR C2KLWC3RKII{Amide} | 0.014 | 2.0 | 0.16 | 0.07 | 11 |
| 7 | [Ala6]JzTx-V(1-29) | YC1QKWAWTC2DSKRAC3C1EGLR C2KLWC3RKII{Amide} | 0.094 | >5 | 0.28 | 0.16 | 3 |
| 8 | [Ala7]JzTx-V(1-29) | YC1QKWMATC2DSKRAC3C1EGLR C2KLWC3RKII{Amide} | 0.15 | >5 | 0.69 | 0.94 | 5 |
| 30 | [1-Nal7]JzTx-V(1-29) | YC1QKWM[1-Nal]TC2DSKRAC3 C1EGLRC2KLWC3RKII{Amide} | 0.013 | 3.6 | 0.12 | 0.10 | 9 |
| 54 | [Glu7]JzTx-V(1-29) | YC1QKWMETC2DSKRAC3C1EGLR C2KLWC3RKII{Amide} | 0.56 | >5.0 | 2.6 | 2.8 | 5 |
| 75 | [Lys7]JzTx-V(1-29) | YC1QKWMKTC2DSKRAC3C1EGLR C2KLWC3RKII{Amide} | 0.080 | >5.0 | 0.43 | 0.31 | 5 |
| 95 | [Arg7]JzTx-V(1-29) | YC1QKWMRTC2DSKRAC3C1EGLR C2KLWC3RKII{Amide} | 0.053 | >5.0 | 0.40 | 0.08 | 8 |
| 9 | [Ala8]JzTx-V(1-29) | YC1QKWMWAC2DSKRAC3C1EGLR C2KLWC3RKII{Amide} | 0.025 | >5 | 0.25 | 0.21 | 10 |
| 76 | [Lys8]JzTx-V(1-29) | YC1QKWMWKC2DSKRAC3C1EGLR C2KLWC3RKII{Amide} | 0.031 | 3.7 | 0.10 | 0.10 | 3 |
| 96 | [Arg8]JzTx-V(1-29) | YC1QKWMWRC2DSKRAC3C1EGLR C2KLWC3RKII{Amide} | 0.018 | 1.7 | 0.14 | 0.05 | 7 |
| 11 | [Ala11]JzTx-V(1-29) | YC1QKWMWTC2DAKRAC3C1EGLR C2KLWC3RKII{Amide} | 0.012 | 3.6 | 0.16 | 0.14 | 13 |
| 57 | [Glu11]JzTx-V(1-29) | YC1QKWMWTC2DEKRAC3C1EGLR C2KLWC3RKII{Amide} | 0.039 | >5.0 | 0.38 | 0.19 | 10 |
| 78 | [Lys11]JzTx-V(1-29) | YC1QKWMWTC2DKKRAC3C1EGLR C2KLWC3RKII{Amide} | 0.008 | 1.1 | 0.11 | 0.05 | 13 |
| 98 | [Arg11]JzTx-V(1-29) | YC1QKWMWTC2DRKRAC3C1EGLR C2KLWC3RKII{Amide} | 0.007 | 0.86 | 0.09 | 0.03 | 12 |
| 12 | [Ala12]JzTx-V(1-29) | YC1QKWMWTC2DSARAC3C1EGLR C2KLWC3RKII{Amide} | 0.022 | >5.0 | 0.26 | 0.15 | 12 |
| 99 | [Arg12]JzTx-V(1-29) | YC1QKWMWTC2DSRRAC3C1EGLR C2KLWC3RKII{Amide} | 0.008 | 2.5 | 0.15 | 0.05 | 19 |
| 13 | [Ala13]JzTx-V(1-29) | YC1QKWMWTC2DSKAAC3C1EGLR C2KLWC3RKII{Amide} | 0.079 | >5 | 0.57 | 0.30 | 7 |
| 79 | [Lys13]JzTx-V(1-29) | YC1QKWMWTC2DSKKAC3C1EGLR C2KLWC3RKII{Amide} | 0.064 | >5.0 | 0.47 | 0.12 | 7 |
| 60 | [Glu14]JzTx-V(1-29) | YC1QKWMWTC2DSKREC3C1EGLR C2KLWC3RKII{Amide} | 0.020 | >5.0 | 0.23 | 0.11 | 12 |
| 80 | [Lys14]JzTx-V(1-29) | YC1QKWMWTC2DSKRKC3C1EGLR C2KLWC3RKII{Amide} | 0.007 | 1.5 | 0.07 | 0.03 | 10 |
| 100 | [Arg14]JzTx-V(1-29) | YC1QKWMWTC2DSKRRC3C1EGLR C2KLWC3RKII{Amide} | 0.008 | 1.4 | 0.08 | 0.04 | 11 |
| 14 | [Ala17]JzTx-V(1-29) | YC1QKWMWTC2DSKRAC3C1AGLR C2KLWC3RKII{Amide} | 0.008 | 2.0 | 0.06 | 0.08 | 8 |
| 37 | [1-Nal17]JzTx-V(1-29) | YC1QKWMWTC2DSKRAC3C1[1-Nal]GLRC2KLWC3RKII{Amide} | 0.033 | 2.2 | 0.13 | 0.11 | 4 |

TABLE 6-continued

Electrophysiology by IonWorks ® Quattro: comparison of JzTx-V (SEQ ID NO: 2) and single substitution JzTx-V peptide analogs.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 81 | [Lys17]JzTx-V(1-29) | YC1QKWMWTC2DSKRAC3C1KGLR C2KLWC3RKII{Amide} | 0.010 | 0.89 | 0.05 | 0.03 | 5 |
| 101 | [Arg17]JzTx-V(1-29) | YC1QKWMWTC2DSKRAC3C1RGLR C2KLWC3RKII{Amide} | 0.014 | 0.95 | 0.06 | 0.04 | 4 |
| 15 | [Ala18]JzTx-V(1-29) | YC1QKWMWTC2DSKRAC3C1EALR C2KLWC3RKII{Amide} | 0.040 | >5.0 | 0.26 | 0.24 | 7 |
| 17 | [Ala20]JzTx-V(1-29) | YC1QKWMWTC2DSKRAC3C1EGLA C2KLWC3RKII{Amide} | 0.009 | >5 | 0.42 | 0.26 | 46 |
| 63 | [Glu20]JzTx-V(1-29) | YC1QKWMWTC2DSKRAC3C1EGLE C2KLWC3RKII{Amide} | 0.073 | >5.0 | 4.6 | 2.5 | 63 |
| 84 | [Lys20]JzTx-V(1-29) | YC1QKWMWTC2DSKRAC3C1EGLK C2KLWC3RKII{Amide} | 0.020 | 3.4 | 0.26 | 0.06 | 13 |
| 18 | [Ala22]JzTx-V(1-29) | YC1QKWMWTC2DSKRAC3C1EGLR C2ALWC3RKII{Amide} | 0.062 | >5 | 0.41 | 0.52 | 7 |
| 104 | [Arg22]JzTx-V(1-29) | YC1QKWMWTC2DSKRAC3C1EGLR C2RLWC3RKII{Amide} | 0.016 | 2.0 | 0.17 | 0.08 | 11 |
| 19 | [Ala23]JzTx-V(1-29) | YC1QKWMWTC2DSKRAC3C1EGLR C2KAWC3RKII{Amide} | 0.30 | >5 | 0.34 | 0.44 | 1 |
| 42 | [1-Nal23]JzTx-V(1-29) | YC1QKWMWTC2DSKRAC3C1EGLR C2K[1-Nal]WC3RKII{Amide} | 0.050 | 1.5 | 0.17 | 0.17 | 3 |
| 65 | [Glu23]JzTx-V(1-29) | YC1QKWMWTC2DSKRAC3C1EGLR C2KEWC3RKII{Amide} | 4.0 | >5.0 | >5.0 | 2.0 | 1 |
| 85 | [Lys23]JzTx-V(1-29) | YC1QKWMWTC2DSKRAC3C1EGLR C2KKWC3RKII{Amide} | 0.24 | 4.1 | 0.29 | 0.14 | 1 |
| 105 | [Arg23]JzTx-V(1-29) | YC1QKWMWTC2DSKRAC3C1EGLR C2KRWC3RKII{Amide} | 0.15 | 2.8 | 0.21 | 0.15 | 1 |
| 43 | [1-Nal24]JzTx-V(1-29) | YC1QKWMWTC2DSKRAC3C1EGLR C2KL[1-Nal]C3RKII{Amide} | 0.075 | >5 | 0.33 | 0.46 | 4 |
| 106 | [Arg24]JzTx-V(1-29) | YC1QKWMWTC2DSKRAC3C1EGLR C2KLRC3RKII{Amide} | 5.0 | >5.0 | 2.5 | 4.8 | 1 |
| 107 | [Arg27]JzTx-V(1-29) | YC1QKWMWTC2DSKRAC3C1EGLR C2KLWC3RRII{Amide} | 0.028 | >5.0 | 0.23 | 0.10 | 8 |
| 23 | [Ala28]JzTx-V(1-29) | YC1QKWMWTC2DSKRAC3C1EGLR C2KLWC3RKAI{Amide} | 0.030 | >5 | 0.29 | 0.25 | 10 |
| 46 | [1-Nal28]JzTx-V(1-29) | YC1QKWMWTC2DSKRAC3C1EGLR C2KLWC3RK[1-Nal]I{Amide} | 0.006 | 3.6 | 0.10 | 0.06 | 17 |
| 69 | [Glu28]JzTx-V(1-29) | YCHIKWMWTC2DSKRAC3C1EGLR C2KLWC3RKEI{Amide} | 0.028 | >5.0 | 0.83 | 0.33 | 30 |
| 88 | [Lys28]JzTx-V(1-29) | YC1QKWMWTC2DSKRAC3C1EGLR C2KLWC3RKKI{Amide} | 0.014 | 1.5 | 0.11 | 0.05 | 8 |
| 108 | [Arg28]JzTx-V(1-29) | YC1QKWMWTC2DSKRAC3C1EGLR C2KLWC3RKRI{Amide} | 0.026 | 1.8 | 0.14 | 0.06 | 5 |
| 24 | [Ala29]JzTx-V(1-29) | YC1QKWMWTC2DSKRAC3C1EGLR C2KLWC3RKIA{Amide} | 0.053 | >5 | 0.27 | 0.45 | 5 |
| 70 | [Glu29]JzTx-V(1-29) | YC1QKWMWTC2DSKRAC3C1EGLR C2KLWC3RKIE{Amide} | 0.28 | >5.0 | >5.0 | 5.0 | 18 |
| 89 | [Lys29]JzTx V(1 29) | YC1QKWMWTC2DSKRAC3C1EGLR C2KLWC3RKIK{Amide} | 0.11 | >5.0 | 1.3 | 2.4 | 11 |

TABLE 6-continued

Electrophysiology by IonWorks ® Quattro: comparison of JzTx-V (SEQ ID NO: 2) and single substitution JzTx-V peptide analogs.

| SEQ ID NO. | Designation | Sequence | IC50 (μM) Nav1.7 | Nav1.5 | Nav1.4 | Nav1.3 | Nav1.4/Nav1.7 |
|---|---|---|---|---|---|---|---|
| 109 | [Arg29]JzTx-V(1-29) | YC1QKWMWTC2DSKRAC3C1EGLRC2KLWC3RKIR{Amide} | 0.067 | >5.0 | 1.1 | 1.3 | 16 |
| 48 | JzTx-45 | YCQKWMWTCDSERKCCEGYVCELWCKYNL{Amide} | 0.084 | >5 | 2.4 | 1.8 | 28 |
| 430 | JzTx-46 | YCQKWMWTCDSERKCCEGYVCELWCKYNM{Amide} | 0.33 | >5 | >5 | 5 | 15 |

TABLE 7

Electrophysiology by IonWorks ® Quattro position 20 substitutions and combinations relative to SEQ ID NO: 2.

| SEQ ID NO. | Designation | Sequence | IC50 (μM) Nav1.7 | Nav1.5 | Nav1.4 | Nav1.3 | Nav1.4/Nav1.7 |
|---|---|---|---|---|---|---|---|
| 2 | JzTx-V(1-29) | YCQKWMWTCDSKRACCEGLRCKLWCRKII | 0.02 | 7.2 | 0.2 | 0.31 | 13 |
| 125 | [Ser20]JzTx-V(1-29) | YCQKWMWTCDSKRACCEGLSCKLWCRKII | 0.03 | 9.2 | 0.4 | 0.29 | 17 |
| 122 | [Cit20]JzTx-V(1-29) | YCQKWMWTCDSKRACCEGL[Cit]CKLWCRKII | 0.04 | 6.8 | 0.5 | 0.35 | 15 |
| 117 | [Abu20]JzTx-V(1-29) | YCQKWMWTCDSKRACCEGL[Abu]CKLWCRKII | 0.05 | 10.6 | 0.9 | 0.97 | 19 |
| 121 | [Gly20]JzTx-V(1-29) | YCQKWMWTCDSKRACCEGLGCKLWCRKII | 0.06 | 9.8 | 1.9 | 0.98 | 29 |
| 119 | [Leu20]JzTx-V(1-29) | YCQKWMWTCDSKRACCEGLLCKLWCRKII | 0.07 | 8.3 | 1.0 | 2.51 | 14 |
| 118 | [Ile20]JzTx-V(1-29) | YCQKWMWTCDSKRACCEGLICKLWCRKII | 0.09 | 8.6 | 1.3 | 2.20 | 15 |
| 124 | [Tyr20]JzTx-V(1-29) | YCQKWMWTCDSKRACCEGLYCKLWCRKII | 0.09 | 10.8 | 4.0 | >5.00 | 43 |
| 115 | [Asp20]JzTx-V(1-29) | YCQKWMWTCDSKRACCEGLDCKLWCRKII | 0.09 | 11.1 | >5.0 | >5.00 | 53 |
| 120 | [Val20]JzTx-V(1-29) | YCQKWMWTCDSKRACCEGLVCKLWCRKII | 0.10 | 7.1 | 3.0 | 3.37 | 31 |
| 123 | [Nva20]JzTx-V(1-29) | YCQKWMWTCDSKRACCEGL[Nva]CKLWCRKII | 0.17 | 10.4 | 3.1 | >5.00 | 19 |
| 114 | [Cpa20]JzTx-V(1-29) | YCQKWMWTCDSKRACCEGL[Cpa]CKLWCRKII | 0.21 | 14.2 | >5.0 | >5.00 | 24 |
| 63 | [Glu20]JzTx-V(1-29) | YCQKWMWTCDSKRACCEGLECKLWCRKII | 0.36 | 9.8 | >5.0 | >5.00 | 14 |
| 112 | [Glu20;Trp29]JzTx-V(1-29) | YCQKWMWTCDSKRACCEGLECKLWCRKIW | 0.03 | 6.9 | >5.0 | 3.62 | 178 |
| 136 | [Glu20;Nva28]JzTx-V(1-29) | YCQKWMWTCDSKRACCEGLECKLWCRK[Nva]I | 0.08 | 8.9 | >5.0 | >5.00 | 66 |
| 133 | [Glu20;Val28]JzTx-V(1-29) | YCQKWMWTCDSKRACCEGLECKLWCRKVI | 0.08 | 12.0 | 4.0 | 4.85 | 51 |

TABLE 7-continued

Electrophysiology by IonWorks ® Quattro position 20 substitutions and combinations relative to SEQ ID NO: 2.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 138 | [Glu20;Ser28]JzTx-V(1-29) | YCQKWMWTCDSKRACCE GLECKLWCRKSI | 0.08 | 13.9 | >5.0 | >5.00 | 62 |
| 137 | [Glu20;Tyr28]JzTx-V(1-29) | YCQKWMWTCDSKRACCE GLECKLWCRKYI | 0.09 | 8.0 | >3.5 | 2.01 | 41 |
| 135 | [Glu20;Cit28]JzTx-V(1-29) | YCQKWMWTCDSKRACCE GLECKLWCRK[Cit]I | 0.11 | 12.0 | >5.0 | >5.00 | 46 |
| 136 | [Glu20;Nva28]JzTx-V(1-29) | YCQKWMWTCDSKRACCE GLECKLWCRK[Nva]I | 0.15 | 15.8 | >5.0 | >5.00 | 34 |
| 138 | [Glu20;Ser28]JzTx-V(1-29) | YCQKWMWTCDSKRACCE GLECKLWCRKSI | 0.15 | 9.2 | >5.0 | >5.00 | 34 |
| 113 | [Glu20]JzTx-V(1-29)-Trp | YCQKWMWTCDSKRACCE GLECKLWCRKIIW | 0.17 | 11.1 | >5.0 | >5.00 | 30 |
| 130 | [Glu20;Abu28]JzTx-V(1-29) | YCQKWMWTCDSKRACCE GLECKLWCRK[Abu]I | 0.17 | 8.2 | >5.0 | >5.00 | 29 |
| 130 | [Glu20;Abu28]JzTx-V(1-29) | YCQKWMWTCDSKRACCE GLECKLWCRK[Abu]I | 0.21 | 11.1 | >5.0 | >5.00 | 24 |
| 134 | [Glu20;Gly28]JzTx-V(1-29) | YCQKWMWTCDSKRACCE GLECKLWCRKGI | 0.30 | 10.9 | >5.0 | >5.00 | 17 |
| 134 | [Glu20;Gly28]JzTx-V(1-29) | YCQKWMWTCDSKRACCE GLECKLWCRKGI | 0.37 | 11.1 | >5.0 | >5.00 | 13 |
| 132 | [Glu20;Leu28]JzTx-V(1-29) | YCQKWMWTCDSKRACCE GLECKLWCRKLI | 0.41 | 6.7 | >5.0 | >5.00 | 12 |
| 111 | [Nva6;Glu20]JzTx-V(1-29) | YCQKW[Nva]WTCDSKR ACCEGLECKLWCRKII | 0.69 | 9.2 | >5.0 | >5.00 | 7 |
| 126 | [Glu20,28]JzTx-V(1-29) | YCQKWMWTCDSKRACCE GLECKLWCRKEI | 0.95 | 15.8 | >5.0 | >5.00 | 5 |
| 128 | [Glu20;Asp28]JzTx-V(1-29) | YCQKWMWTCDSKRACCE GLECKLWCRKDI | 1.34 | 13.9 | >5.0 | >5.00 | 4 |
| 126 | [Glu20,28]JzTx-V(1-29) | YCQKWMWTCDSKRACCE GLECKLWCRKEI | 1.44 | 7.5 | >5.0 | >5.00 | 3 |
| 127 | [Glu20;Cpa28]JzTx-V(1-29) | YCQKWMWTCDSKRACCE GLECKLWCRK[Cpa]I | 2.35 | 16.7 | >5.0 | >5.00 | 2 |

TABLE 8

Electrophysiology by IonWorks ® Quattro Position 20 substitutions relative to SEQ ID NO: 2.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 2 | JzTx-V(1-29) | YCQKWMWTCDSKRACCEG LRCKLWCRKII | 0.04 | >7 | 0.20 | 0.12 | 5 |
| 192 | [pl-Phe5;Glu20;Tyr28]JzTx-V(1-29) | YCQK[pl-Phe]MWTCDS KRACCEGLECKLWCRKYI | 0.11 | >5 | 3.4 | 1.3 | 30 |
| 193 | [Phe5;Glu20;Tyr28]JzTx-V(1-29) | YCQKFMWTCDSKRACCEG LECKLWCRKYI | 0.16 | >5 | >5 | >5 | |
| 193 | [Phe5;Glu20;Tyr28]JzTx-V(1-29) | YCQKFMWTCDSKRACCEG LECKLWCRKYI | 0.23 | >5 | >5 | >5 | |

TABLE 8-continued

Electrophysiology by IonWorks ® Quattro Position 20 substitutions relative to SEQ ID NO: 2.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 194 | [Tyr5,28;Glu20]JzTx-V(1-29) | YCQKYMWTCDSKRACCEG LECKLWCRKYI | 0.91 | >5 | >5 | >5 | |
| 194 | [Tyr5,28;Glu20]JzTx-V(1-29) | YCQKYMWTCDSKRACCEG LECKLWCRKYI | 2.5 | >5 | >5 | >5 | |
| 195 | [Val5;Glu20;Tyr28]JzTx-V(1-29) | YCQKVMWTCDSKRACCEG LECKLWCRKYI | 3.8 | >5 | >5 | >5 | |
| 196 | [Leu5;Glu20;Tyr28]JzTx-V(1-29) | YCQKLMWTCDSKRACCEG LECKLWCRKYI | >5 | >5 | >5 | >5 | |
| 198 | [Nva5;Glu20;Tyr28]JzTx-V(1-29) | YCQK[Nva]MWTCDSKRA CCEGLECKLWCRKYI | 3.3 | >5 | >5 | >5 | |
| 199 | [Cit5;Glu20;Tyr28]JzTx-V(1-29) | YCQK[Cit]MWTCDSKRA CCEGLECKLWCRKYI | >5 | >5 | >5 | >5 | |
| 200 | [Lys5;Glu20;Tyr28]JzTx-V(1-29) | YCQKKMWTCDSKRACCEG LECKLWCRKYI | >5 | >5 | >5 | >5 | |
| 201 | [Asn5;Glu20;Tyr28]JzTx-V(1-29) | YCQKNMWTCDSKRACCEG LECKLWCRKYI | 4.2 | >5 | >5 | >5 | |
| 201 | [Asn5;Glu20;Tyr28]JzTx-V(1-29) | YCQKNMWTCDSKRACCEG LECKLWCRKYI | >5 | >5 | >5 | >5 | |
| 203 | [Glu5,20;Tyr28]JzTx-V(1-29) | YCQKEMWTCDSKRACCEG LECKLWCRKYI | >7 | >7 | >7 | >7 | |
| 212 | [Nva7;Glu20;Tyr28]JzTx-V(1-29) | YCQKWM[Nva]TCDSKRA CCEGLECKLWCRKYI | 4.5 | >7 | >7 | >7 | |
| 213 | [Cit7;Glu20;Tyr28]JzTx-V(1-29) | YCQKWM[Cit]TCDSKRA CCEGLECKLWCRKYI | 5.8 | >7 | >7 | >7 | |
| 214 | [Lys7;Glu20;Tyr28]JzTx-V(1-29) | YCQKWMKTCDSKRACCEG LECKLWCRKYI | 2.7 | >7 | >7 | >7 | |
| 215 | [Asn7;Glu20;Tyr28]JzTx-V(1-29) | YCQKWMNTCDSKRACCEG LECKLWCRKYI | 5.0 | >7 | 6.1 | >7 | 1 |
| 216 | [Ser7;Glu20;Tyr28]JzTx-V(1-29) | YCQKWMSTCDSKRACCEG LECKLWCRKYI | 4.7 | >7 | >7 | >7 | |
| 216 | [Ser7;Glu20;Tyr28]JzTx-V(1-29) | YCQKWMSTCDSKRACCEG LECKLWCRKYI | 6.6 | 5.4 | >7 | >7 | |
| 217 | [Glu7,20;Tyr28]JzTx-V(1-29) | YCQKWMETCDSKRACCEG LECKLWCRKYI | >7 | >7 | >7 | >7 | |
| 217 | [Glu7,20;Tyr28]JzTx-V(1-29) | YCQKWMETCDSKRACCEG LECKLWCRKYI | >7 | >7 | >7 | >7 | |
| 218 | [Glu20;1-Nal24;Tyr28]JzTx-V(1-29) | YCQKWMWTCDSKRACCEG LECKL[1-Nal]CRKYI | 0.30 | >7 | >7 | >7 | |
| 219 | [Glu20;2-Nal24;Tyr28]JzTx-V(1-29) | YCQKWMWTCDSKRACCEG LECKL[2-Nal]CRKYI | 0.86 | >7 | >7 | >7 | |
| 219 | [Glu20;2-Nal24;Tyr28]JzTx-V(1-29) | YCQKWMWTCDSKRACCEG LECKL[2-Nal]CRKYI | 1.0 | >7 | >7 | >7 | |
| 223 | [Glu20;Val24;Tyr28]JzTx-V(1-29) | YCQKWMWTCDSKRACCEG LECKLVCRKYI | >5 | >5 | >5 | >5 | |
| 224 | [Glu20;Leu24;Tyr28]JzTx-V(1-29) | YCQKWMWTCDSKRACCEG LECKLLCRKYI | >5 | >5 | >5 | >5 | |
| 225 | [Glu20;Nle24;Tyr28]JzTx-V(1-29) | YCQKWMWTCDSKRACCEG LECKL[Nle]CRKYI | >5 | >5 | >5 | >5 | |

TABLE 8-continued

Electrophysiology by IonWorks ® Quattro Position 20 substitutions relative to SEQ ID NO: 2.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 226 | [Glu20;Nva24;Tyr28]JzTx-V(1-29) | YCQKWMWTCDSKRACCEG LECKL[Nva]CRKYI | >5 | >5 | >5 | >5 | |
| 228 | [Glu20;Lys24;Tyr28]JzTx-V(1-29) | YCQKWMWTCDSKRACCEG LECKLKCRKYI | 2.7 | >5 | >5 | >5 | |
| 229 | [Glu20;Asn24;Tyr28]JzTx-V(1-29) | YCQKWMWTCDSKRACCEG LECKLNCRKYI | >5 | >5 | >5 | >5 | |
| 232 | [Glu20;Tyr28;1-Nal29]JzTx-V(1-29) | YCQKWMWTCDSKRACCEG LECKLWCRKY[1-Nal] | 0.050 | 4.6 | 4.6 | 2.1 | 91 |
| 233 | [Glu20;Tyr28;2-Nal29]JzTx-V(1-29) | YCQKWMWTCDSKRACCEG LECKLWCRKY[2-Nal] | 0.044 | >5 | >5 | 2.2 | |
| 238 | [Glu20;Tyr28;Leu29]JzTx-V(1-29) | YCQKWMWTCDSKRACCEG LECKLWCRKYL | 0.084 | >5 | 4.5 | 3.0 | |
| 238 | [Glu20;Tyr28;Leu29]JzTx-V(1-29) | YCQKWMWTCDSKRACCEG LECKLWCRKYL | 0.23 | >5 | >5 | >5 | |
| 239 | [Glu20;Tyr28;Nle29]JzTx-V(1-29) | YCQKWMWTCDSKRACCEG LECKLWCRKY[Nle] | 0.079 | >5 | >5 | 4.0 | |
| 241 | [Glu20;Tyr28;Cit29]JzTx-V(1-29) | YCQKWMWTCDSKRACCEG LECKLWCRKY[Cit] | 1.2 | >5 | >5 | >5 | |
| 242 | [Glu20;Tyr28;Lys29]JzTx-V(1-29) | YCQKWMWTCDSKRACCEG LECKLWCRKYK | 0.45 | >5 | >5 | >5 | |
| 242 | [Glu20;Tyr28;Lys29]JzTx-V(1-29) | YCQKWMWTCDSKRACCEG LECKLWCRKYK | 0.63 | >5 | >5 | >5 | |
| 243 | [Glu20;Tyr28;Asn29]JzTx-V1-29) | YCQKWMWTCDSKRACCEG LECKLWCRKYN | 0.52 | >5 | >5 | >5 | |
| 244 | [Glu20;Tyr28;Ser29]JzTx-V(1-29) | YCQKWMWTCDSKRACCEG LECKLWCRKYS | 0.34 | >5 | >5 | >5 | |
| 245 | [Glu20,29;Tyr28]JzTx-V(1-29) | YCQKWMWTCDSKRACCEG LECKLWCRKYE | 4.7 | >5 | >5 | >5 | |
| 272 | [Nle6]JzTx-V(1-29) | YCQKW[Nle]WTCDSKRA CCEGLRCKLWCRKII | >5 | >5 | >5 | >5 | |
| 273 | [Nle6;Glu20]JzTx-V(1-29) | YCQKW[Nle]WTCDSKRA CCEGLECKLWCRKII | 0.19 | >5 | >5 | 4.1 | |
| 277 | [Glu1,20;Tyr28]JzTx-V(1-29) | ECQKWMWTCDSKRACCEG LECKLWCRKYI | 0.21 | 2.0 | >5 | >5 | |
| 278 | [Glu1;Tyr28]JzTx-V(1-29) | ECQKWMWTCDSKRACCEG LRCKLWCRKYI | 0.046 | >5 | 0.7 | 0.3 | 16 |
| 281 | [Glu14-Nal7]JzTx-V(1-29) | ECQKWM[1-Nal]TCDSK RACCEGLRCKLWCRKII | 0.032 | >5 | 0.7 | 0.4 | 21 |
| 281 | [Glu14-Nal7]JzTx-V(1-29) | ECQKWM[1-Nal]TCDSK RACCEGLRCKLWCRKII | 0.047 | >5 | 0.5 | 0.5 | 10 |

TABLE 9

Electrophysiology by IonWorks ® Quattro: PEGylated JzTx-V peptide analogs.

| SEQ ID NO. | Designation | Sequence | IC50 (μM) Nav1.7 | Nav1.5 | Nav1.4 | Nav1.3 | Nav1.4/ Nav1.7 |
|---|---|---|---|---|---|---|---|
| 165 | [Atz(NPEG10)1;Glu20] JzTx-V(1-29) | [Atz(NPEG10)]CQKWMWTCDSKRACCEGLECKLWCRKII | 0.18 | 15.1 | >5 | >5 | 28 |
| 171 | [Atz(NPEG10)8;Glu20] JzTx-V(1-29) | YCQKWMW[Atz(NPEG10)]CDSKRACCEGLECKLWCRKII | 5.00 | 18.7 | >5 | >5 | 1 |
| 178 | [Atz(NPEG10)17;Glu20] JzTx-V(1-29) | YCQKWMWTCDSKRACC[Atz(NPEG10)]GLECKLWCRKII | 0.18 | 15.1 | >5 | >5 | 28 |
| 183 | [Glu20;Atz(NPEG10)23] JzTx-V(1-29) | YCQKWMWTCDSKRACCEGLECK[Atz(NPEG10)]WCRKII | 5.00 | 19.2 | >5 | >5 | 1 |
| 187 | [Glu20;Atz(NPEG10)28] JzTx-V(1-29) | YCQKWMWTCDSKRACCEGLECKLWCRK[Atz(NPEG10)]I | 1.77 | 15.4 | >5 | >5 | 3 |
| 188 | [Glu20;Atz(NPEG10)29] JzTx-V(1-29) | YCQKWMWTCDSKRACCEGLECKLWCRKI[Atz(NPEG10)] | 5.00 | 20.1 | >5 | >5 | 1 |
| 247 | Atz(NPEG10)-[Nle6] JzTx-V(1-29) | [Atz-NPEG10]YCQKW[Nle]WTCDSKRACCEGLRCKLWCRKII | 0.07 | 4.3 | 0.15 | 0.13 | 2 |
| 248 | [Atz(NPEG10)1;Nle6] JzTx-V(1-29) | [Atz-NPEG10]CQKW[Nle]WTCDSKRACCEGLRCKLWCRKII | 0.10 | >7 | 0.39 | 0.16 | 4 |
| 248 | [Atz(NPEG10)1;Nle6] JzTx-V(1-29) | [Atz-NPEG10]CQKW[Nle]WTCDSKRACCEGLRCKLWCRKII | 0.14 | >7 | 0.45 | 0.13 | 3 |
| 251 | [Atz(NPEG10)5;Nle6] JzTx-V(1-29) | YCQK[Atz-NPEG10][Nle]WTCDSKRACCEGLRCKLWCRKII | >7 | >7 | >7 | >7 | |
| 253 | [Nle6;Atz(NPEG10)7] JzTx-V(1-29) | YCQKW[Nle][Atz-NPEG10]TCDSKRACCEGLRCKLWCRKII | 4.6 | >7 | >7 | >7 | |
| 254 | [Nle6;Atz(NPEG10)8] JzTx-V(1-29) | YCQKW[Nle]W[Atz-NPEG10]CDSKRACCEGLRCKLWCRKII | 6.4 | >7 | >7 | >7 | |
| 256 | [Nle6;Atz(NPEG10)11] JzTx-V(1-29) | YCQKW[Nle]WTCD[Atz(NPEG10)]KRACCEGLRCKLWCRKII | 0.096 | >5 | 0.4 | 0.2 | 4 |
| 256 | [Nle6;Atz(NPEG10)11] JzTx-V(1-29) | YCQKW[Nle]WTCD[Atz(NPEG10)]KRACCEGLRCKLWCRKII | 0.12 | >5 | 0.5 | 0.4 | 4 |
| 264 | [Nle6;Atz(NPEG10)22] JzTx-V(1-29) | YCQKW[Nle]WTCDSKRACCEGLRC[Atz-NPEG10]LWCRKII | >7 | >7 | >7 | >7 | |
| 265 | [Nle6;Atz(NPEG10)23] JzTx-V(1-29) | YCQKW[Nle]WTCDSKRACCEGLRCK[Atz-NPEG10]WCRKII | 4.8 | >7 | >7 | 5.6 | |
| 270 | [Nle6;Atz(NPEG10)29] JzTx-V(1-29) | YCQKW[Nle]WTCDSKRACCEGLRCKLWCRKI[Atz-NPEG10] | 0.40 | >7 | 0.75 | 3.9 | 2 |
| 283 | [Nle6,Pra14] JzTx-V(1-29) | YCQKW[Nle]WTCDSKR[Pra]CCEGLRCKLWCRKII | 0.07 | >7 | 0.09 | 0.06 | 1 |

TABLE 10

Electrophysiology by IonWorks ® Quattro: JzTx-V analogs for conjugation.

| SEQ ID NO. | Designation | Sequence | Nav1.7 IC50 (μM) |
|---|---|---|---|
| 425 | Pra-[Nle6]JzTx-V | [Pra]YCQKW[Nle]WTCDSKRACCEGLRCKLWCRKII | 0.008 |
| 425 | Pra-[Nle6]JzTx-V | [Pra]YCQKW[Nle]WTCDSKRACCEGLRCKLWCRKII | 0.013 |

TABLE 10-continued

Electrophysiology by IonWorks ® Quattro: JzTx-V analogs for conjugation.

| SEQ ID NO. | Designation | Sequence | Nav1.7 IC50 (μM) |
|---|---|---|---|
| 112 | [Glu20,Trp29]JzTx-V | YCQKWMWTCDSKRACCEGLECKLWCRKIW | 0.017 |
| 295 | Pra-[Glu20;Trp29] JzTx-V(1-29) | [Pra]YCQKWMWTCDSKRACCEGLECKLWCRKIW | 0.018 |

TABLE 10-continued

Electrophysiology by IonWorks ® Quattro: JzTx-V analogs for conjugation.

| SEQ ID NO. | Designation | Sequence | Nav1.7 IC50 (μM) |
|---|---|---|---|
| 296 | Pra-[Nle6;Trp29] JzTx-V(1-29) | [Pra]YCQKW[Nle]WTCD SKRACCEGLRCKLWCRKIW | 0.019 |
| 294 | [Nle6;Glu20;Trp29] JzTx-V(1-29) | YCQKW[Nle]WTCDSKRAC CEGLECKLWCRKIW | 0.024 |
| 294 | [Nle6;Glu20;Trp29] JzTx-V(1-29) | YCQKW[Nle]WTCDSKRAC CEGLECKLWCRKIW | 0.026 |
| 302 | [Nle6;Pra11;Glu20; Trp29]JzTx-V(1-29) | YCQKW[Nle]WTCD[Pra] KRACCEGLECKLWCRKIW | 0.026 |
| 291 | [Nle6;Lys(Pra-NPEG3) 14;Glu20;Trp29]JzTx-V(1-29) | YCQKW[Nle]WTCDSKR [KPPG3]CCEGLECKLWC RKIW | 0.028 |
| 301 | Pra-[Nle6;Glu20; Phe29]JzTx-V(1-29) | [Pra]YCQKW[Nle]WTCDS KRACCEGLECKLWCRKIF | 0.035 |
| 293 | [Nle6;Lys(Pra-NPEG3) 17;Glu20;Trp29]JzTx-V(1-29) | YCQKW[Nle]WTCDSKRACC [KPPG3]GLECKLWCRKIW | 0.041 |
| 290 | [Nle6;Lys(Pra-NPEG11) 14;Glu20;Trp29]JzTx-V(1-29) | YCQKW[Nle]WTCDSKR [KPPG11]CCEGLECKLWC RKIW | 0.052 |
| 322 | [Nle6;AzK17;Glu20; Tyr28]JzTx-V(1-29) | YCQKW[Nle]WICDSKRACC [AzK]GLECKLWCRKYI | 0.067 |
| 292 | [Nle6;Lys(Pra-NPEG11) 17;Glu20;Trp29]JzTx-V(1-29) | YCQKW[Nle]WTCDSKRACC [KPPG11]GLECKLWCRKIW | 0.082 |

TABLE 11

Electrophysiology by PatchXpress ® (PX) of single substitution and combination JzTx-V analogs.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| 1 | JzTx-V(1-29)-FreeAcid | 0.013100 | 0.0746 | | 6 | |
| 2 | JzTx-V(1-29) | 0.001000 | 0.0030 | 2.21 | 3 | 2210 |
| 2 | JzTx-V(1-29) | 0.000200 | 0.0020 | 3.25 | 10 | 16250 |
| 2 | JzTx-V(1-29) | 0.000700 | 0.0020 | 1.60 | 3 | 2286 |
| 2 | JzTx-V(1-29) | 0.000570 | | | | |
| 48 | JzTx-45 | 0.122000 | 0.3210 | 7.46 | 3 | 61 |
| 17 | [Ala20]JzTx-V(1-29) | 0.012000 | 0.1000 | 2.75 | 8 | 229 |
| 30 | [1-Nal7]JzTx-V(1-29) | 0.000400 | 0.0009 | 1.42 | 2 | 3550 |
| 49 | [Glu1]JzTx-V(1-29) | 0.000300 | 0.0080 | 6.44 | 27 | 21467 |
| 50 | [Glu3]JzTx-V(1-29) | 0.058710 | 0.4533 | | 8 | |
| 51 | [Glu4]JzTx-V(1-29) | 0.846700 | | | | |
| 52 | [Glu5]JzTx-V(1-29) | >1.0 | 0.0031 | | | |
| 58 | [Glu12]JzTx-V(1-29) | 0.000904 | 0.0432 | | 48 | |
| 63 | [Glu20]JzTx-V(1-29) | 0.007000 | 1.2500 | 9.33 | 179 | 1333 |
| 64 | [Glu22]JzTx-V(1-29) | 0.929500 | 4.3390 | | 5 | |
| 67 | [Glu26]JzTx-V(1-29) | >1.0 | | | | |
| 68 | [Glu27]JzTx-V(1-29) | 0.012260 | 0.3240 | | 26 | |
| 69 | [Glu28]JzTx-V(1-29) | 0.001000 | 0.3000 | 8.80 | 300 | 8800 |
| 70 | [Glu29]JzTx-V(1-29) | 0.261000 | 11.3000 | >10.00 | 43 | >38 |
| 112 | [Glu20; Trp29]JzTx-V(1-29) | 0.002800 | 1.1300 | 3.42 | 404 | 1221 |
| 112 | [Glu20; Trp29]JzTx-V(1-29) | 0.000670 | 0.8240 | 3.95 | 1230 | 5896 |
| 112 | [Glu20; Trp29]JzTx-V(1-29) | 0.001300 | 1.0500 | 4.41 | 808 | 3392 |
| 112 | [Glu20; Trp29]JzTx-V(1-29) | 0.000500* | 1.3470 | 1.32 | 2694 | 2644 |
| 112 | [Glu20, Trp29]JzTx-V | 0.001411 | | | | |
| 112 | [Glu20, Trp29]JzTx-V | 0.002154 | | | | |
| 112 | [Glu20; Trp29]JzTx-V(1-29) | 0.001821 | | | | |
| 112 | [Glu20, Trp29]JzTx-V | 0.002115 | 2.3651 | 1.62 | 1118 | 767 |
| 115 | [Asp20]JzTx-V(1-29) | 0.749000 | 7.6000 | 3.20 | 10 | 4 |
| 121 | [Gly20]JzTx-V(1-29) | 0.007800 | 0.1970 | 14.10 | 25 | 1808 |
| 124 | [Tyr20]JzTx-V(1-29) | 0.005900 | 1.5700 | >10.00 | 266 | >1695 |
| 133 | [Glu20; Val28]JzTx-V(1-29) | 0.004100 | 1.3100 | 5.50 | 320 | 1341 |
| 135 | [Glu20; Cit28]JzTx-V(1-29) | 0.005600 | 6.0200 | >10.00 | 1075 | >1786 |
| 136 | [Glu20; Nva28]JzTx-V(1-29) | 0.012800 | 5.1900 | 7.82 | 405 | 611 |
| 137 | [Glu20; Tyr28]JzTx-V(1-29) | 0.000900 | 1.2700 | 11.40 | 1411 | 12667 |
| 138 | [Glu20; Ser28]JzTx-V(1-29) | 0.003300 | 4.7900 | >10.00 | 1452 | >3030 |
| 138 | [Glu20; Ser28]JzTx-V(1-29) | 0.002000 | 3.5800 | >10.00 | 1790 | >5000 |
| 138 | [Glu20; Ser28]JzTx-V(1-29) | 0.000400 | 2.9700 | 14.60 | 7425 | 36500 |
| 218 | [Glu20; 1-Nal24; Tyr28]JzTx-V(1-29) | 0.012000 | 5.2130 | 10.00 | 434 | 833 |
| 193 | [Phe5; Glu20; Tyr28]JzTx-V(1-29) | 0.004600* | 1.0000 | >1.00 | 217 | 217 |
| 232 | [Glu20; Tyr28; 1-Nal29]JzTx-V(1-29) | 0.004500* | 1.6740 | 2.16 | 372 | 480 |
| 233 | [Glu20; Tyr28; 2-Nal29]JzTx-V(1-29) | 0.004600* | 1.2190 | 1.99 | 265 | 433 |
| 238 | [Glu20; Tyr28; Leu29]JzTx-V(1-29) | 0.002600* | 0.6260 | 7.33 | 241 | 2817 |
| 239 | [Glu20; Tyr28; Nle29]JzTx-V(1-29) | 0.006200* | 0.7860 | 9.77 | 127 | >1575 |

TABLE 11-continued

Electrophysiology by PatchXpress ® (PX) of single substitution and combination JzTx-V analogs.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| 277 | [Glu1, 20; Tyr28]JzTx-V(1-29) | 0.005500* | 0.9390 | >10.00 | 171 | >1818 |
| 192 | [pI-Phe5; Glu20; Tyr28]JzTx-V(1-29) | 0.002200* | 0.1720 | >1.00 | 78 | >455 |
| | N-Terminal Analogs | | | | | |
| 425 | Pra-[Nle6]JzTx-V | 0.000037 | 0.0040 | 0.97 | 109 | 26092 |
| 425 | Pra-[Nle6]JzTx-V | 0.000763 | | | | |
| 425 | Pra-[Nle6]JzTx-V(1-29) | 0.002150 | 0.0025 | 0.70 | 1 | 327 |
| 369 | Nva-[Nle6]JzTx-V(1-29) | 0.000021 | 0.0116 | 0.49 | 552 | 23418 |
| 369 | Nva-[Nle6]JzTx-V(1-29) | 0.001184 | | | | |
| 361 | Leu-[Nle6]JzTx-V(1-29) | 0.000134 | | | 0 | 0 |
| 368 | Abu-[Nle6]JzTx-V(1-29) | 0.000143 | 0.0110 | 0.48 | 77 | 3332 |
| 373 | D-Leu-[Nle6]JzTx-V(1-29) | 0.000151 | 0.0287 | 0.41 | 190 | 2704 |
| 370 | Nle-[Nle6]JzTx-V(1-29) | 0.000223 | 0.0046 | 0.83 | 21 | 3729 |
| 357 | Ala-[Nle6]JzTx-V(1-29) | 0.000307 | | | | |
| 366 | CyA-[Nle6]JzTx-V(1-29) | 0.000307 | | | | |
| 375 | Sar-[Nle6]JzTx-V(1-29) | 0.000325 | 0.0061 | 0.83 | 19 | 2541 |
| 364 | Trp-[Nle6]JzTx-V(1-29) | 0.000334 | | | | |
| 374 | D-Phe-[Nle6]JzTx-V(1-29) | 0.000351 | 0.0068 | 0.62 | 19 | 1757 |
| 365 | Tyr-[Nle6]JzTx-V(1-29) | 0.000372 | | | | |
| 362 | Pro-[Nle6]JzTx-V(1-29) | 0.000372 | | | | |
| 359 | Gly-[Nle6]JzTx-V(1-29) | 0.000384 | | | | |
| 379 | hPhe-[Nle6]JzTx-V(1-29) | 0.000476 | 0.0048 | 0.44 | 10 | 916 |
| 367 | AllylG-[Nle6]JzTx-V(1-29) | 0.000488 | | | | |
| 358 | Phe-[Nle6]JzTx-V(1-29) | 0.000493 | | | | |
| 360 | Ile-[Nle6]JzTx-V(1-29) | 0.000519 | | | | |
| 363 | Val-[Nle6]JzTx-V(1-29) | 0.000551 | | | | |
| 272 | [Nle6]JzTx-V(1-29) | 0.000586 | | | | |
| 377 | hLeu-[Nle6]JzTx-V(1-29) | 0.000676 | 0.0085 | 0.42 | 13 | 615 |
| 376 | bAla-[Nle6]JzTx-V(1-29) | 0.000951 | 0.0032 | 0.70 | 3 | 731 |
| 372 | D-Ala-[Nle6]JzTx-V(1-29) | 0.000957 | 0.0051 | 0.73 | 5 | 764 |
| 462 | Leu-[Nle6; Lys17; Glu28]JzTx-V(1-29) | 0.017410 | 0.3553 | | 20 | |
| 464 | D-Leu-[Nle6; Lys17; Glu28]JzTx-V(1-29) | 0.024090 | 0.4336 | | 18 | |
| 466 | NMeLeu-[Nle6; Lys17; Glu28]JzTx-V(1-29) | 0.020050 | 0.3900 | | 19 | |
| 468 | 1-Ach-[Nle6; Lys17; Glu28]JzTx-V(1-29) | 0.009057 | 0.3668 | | 40 | |
| 470 | Leu-Nva-[Nle6; Lys14; Glu28]JzTx-V(1-29) | 0.013510 | 0.4561 | 5.03 | 34 | 372 |
| 471 | Leu-Nva-[Nle6; Lys17; Glu28]JzTx-V(1-29) | 0.029630 | 0.1904 | 3.27 | 6 | 110 |
| 472 | D-Leu-Nva-[Nle6; Lys14; Glu28]JzTx-V(1-29) | 0.014260 | 0.6039 | 4.98 | 42 | 349 |
| 473 | D-Leu-Nva-[Nle6; Lys17; Glu28]JzTx-V(1-29) | 0.012530 | 0.4289 | 2.26 | 34 | 180 |
| | Positional Analogs | | | | | |
| 566 | CyA-[Nle6; Glu28]JzTx-V(1-29) | 0.007015 | 0.7195 | | 103 | |
| 545 | CyA-[Nle6; Lys20]JzTx-V(1-29) | 0.074470 | | | | |
| 457 | Lys-[Nle6; Glu28]JzTx-V(1-29) | >1.0 | >10.0 | >10.0 | | |
| 458 | Lys-[Nle6; Glu28; Trp29]JzTx-V(1-29) | 0.008157 | 0.3086 | 1.65 | 38 | 202 |
| 563 | CyA-[Lys1; Nle6; Glu28]JzTx-V(1-29) | 0.005403 | 0.6816 | | 126 | |
| 565 | CyA-[Nle6; Lys11; Glu28]JzTx-V(1-29) | 0.010010 | 0.7510 | | 75 | |
| 455 | CyA-[Nle6; Lys14; Glu28]JzTx-V(1-29) | 0.006351 | 0.5450 | 6.99 | 86 | 1101 |
| 456 | CyA-[Nle6; Lys17; Glu28]JzTx-V(1-29) | 0.004829 | 0.3266 | 4.67 | 68 | 967 |
| 459 | CyA-[Nle6; Lys17; Glu28; Trp29]JzTx-V(1-29) | 0.009077 | 0.2470 | | 27 | |
| 547 | CyA-[Nle6; Val8; Lys17; Glu28]JzTx-V(1-29) | 0.026570 | | | | |
| 549 | CyA-[Leu3; Nle6; Lys17; Glu28]JzTx-V(1-29) | >1.0 | >10.0 | | | |
| 551 | CyA-[Phe1; Nle6; Lys17; Glu28]JzTx-V(1-29) | 0.020810 | 0.2679 | | 13 | |
| 555 | CyA-[Nle6, 22; Lys17; Glu28]JzTx-V(1-29) | >1.0 | 7.2580 | | | |
| 557 | CyA-[Nle6, 27; Lys17; Glu28]JzTx-V(1-29) | 0.017010 | | | | |

TABLE 11-continued

Electrophysiology by PatchXpress ® (PX) of single substitution and combination JzTx-V analogs.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| 561 | CyA-[Nle6, 12; Lys17; Glu28]JzTx-V(1-29) | 0.011310 | 0.3699 | | 33 | |
| 476 | CyA-[Nle6; Lys20; Trp29]JzTx-V(1-29) | 0.130600 | 1.6360 | 9.32 | 13 | 71 |
| 708 | Glu-[ Nle6; Glu28]JzTx-V(1-29) | 0.000765 | 0.0992 | 7.60 | 130 | 9941 |

* = at high concentrations, compound would wash off slowly or not at all.

TABLE 12

Electrophysiology by PatchXpress ® (PX) of JzTx-V analogs for conjugation.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| | Pra-containing [Glu20, Trp29]JzTx-V analogs | | | | | |
| 298 | Pra-[Phe6; Glu20; Trp29]JzTx-V(1-29) | 0.014987 | 0.6611 | 0.78 | 44 | 52 |
| 299 | Pra-[Leu6; Glu20; Trp29]JzTx-V(1-29) | 0.000571 | 1.1824 | 1.33 | 2069 | 2332 |
| 300 | Pra-[Nva6; Glu20; Trp29]JzTx-V(1-29) | 0.000818 | 0.9675 | 5.30 | 1183 | 6483 |
| 290 | [Nle6; Lys(Pra-NPEG11)14; Glu20; Trp29]JzTx-V(1-29) | 0.520000 | 2.7289 | 6.10 | 5 | 12 |
| 291 | [Nle6; Lys(Pra-NPEG3)14; Glu20; Trp29]JzTx-V(1-29) | 0.030000 | 1.1302 | 3.01 | 38 | 100 |
| 292 | [Nle6; Lys(Pra-NPEG11)17; Glu20; Trp29]JzTx-V(1-29) | 0.900000 | 1.6280 | 3.12 | 2 | 3 |
| 293 | [Nle6; Lys(Pra-NPEG3)17; Glu20; Trp29]JzTx-V(1-29) | 0.570000 | 0.4531 | 0.58 | 1 | 1 |
| 437 | Nva-[Nle6; Lys(Pra)14; Glu20, Trp29]JzTx-V(1-29) | 0.009594 | | | | |
| 441 | Nva-[Leu6; Lys(Pra)14; Glu20; Trp29]JzTx-V(1-29) | 0.010355 | | | | |
| | AzK-containing [Glu20, Trp29]JzTx-V analogs | | | | | |
| 304 | [AzK1; Nle6; Glu20; Trp29]JzTx-V(1-29) | 0.003864 | 1.7362 | 2.56 | 449 | 662 |
| 305 | [Nle6; AzK11; Glu20; Trp29]JzTx-V(1-29) | 0.435437 | | | 0 | 0 |
| 306 | [Nle6; AzK14; Glu20; Trp29]JzTx-V(1-29) | 0.001153 | 0.6347 | 1.97 | 550 | 1712 |
| 307 | [Nle6; AzK17; Glu20; Trp29]JzTx-V(1-29) | 0.009085 | 0.3596 | 0.75 | 40 | 83 |
| | Aha-containing [Glu20, Trp29]JzTx-V analogs | | | | | |
| 308 | Aha-[Nle6; Glu20; Trp29]JzTx-V(1-29) | 0.001124 | 1.1997 | 3.77 | 1068 | 3351 |
| 309 | [Aha1; Nle6; Glu20; Trp29]JzTx-V(1-29) | 0.003207 | 0.7673 | 2.03 | 239 | 634 |
| | Pra-containing [Glu28]JzTx-V analogs | | | | | |
| 328 | Pra-[Nle6; Glu28]JzTx-V(1-29) | 0.000515 | 0.1302 | 3.02 | 253 | 5854 |
| 329 | [Pra1; Nle6; Glu28]JzTx-V(1-29) | 0.000269 | 0.1495 | 4.62 | 555 | 17167 |
| 330 | [Nle6; Pra11; Glu28]JzTx-V(1-29) | 0.000763 | 0.2216 | 5.98 | 291 | 7841 |
| 331 | [Nle6; Pra14; Glu28]JzTx-V(1-29) | 0.000493 | 0.1050 | 3.51 | 213 | 7119 |
| 332 | [Nle6; Pra17; Glu28]JzTx-V(1-29) | 0.003632 | 0.1252 | 3.08 | 34 | 849 |
| 392 | CyA-[Nle6, Lys(Pra)14, Glu28]JzTx-V(1-29) | >0.1 | | | | |
| 392 | CyA-[Nle6, Lys(Pra)14, Glu28]JzTx-V(1-29) | 0.000226 | 0.0861 | | 381 | |
| 392 | CyA-[Nle6, Lys(Pra)14, Glu28]JzTx-V(1-29) | 0.000299 | | | | |
| 392 | CyA-[Nle6, Lys(Pra)14, Glu28]JzTx-V(1-29) | 0.001402 | 0.1082 | 0.92 | 77 | 659 |
| 392 | CyA-[Nle6, Lys(Pra)14, Glu28]JzTx-V(1-29) | 0.002360 | 0.1095 | 1.45 | 46 | 615 |
| 392 | CyA-[Nle6, Lys(Pra)14, Glu28]JzTx-V(1-29) | 0.002573 | 0.1236 | 2.16 | 48 | 841 |
| 395 | CyA-[Nle6, Pra17, Glu28]JzTx-V(1-29) | 0.000144 | 0.0625 | | 434 | |
| 395 | CyA-[Nle6, Pra17, Glu28]JzTx-V(1-29) | 0.002786 | 0.2117 | 0.71 | 76 | 256 |
| 435 | Nva-[Nle6; Lys(Pra)14; Glu28]JzTx-V(1-29) | 0.002189 | 0.2174 | | 99 | |
| 439 | Nva-[Leu6; Lys(Pra)14; Glu28]JzTx-V(1-29) | 0.001038 | 0.2934 | | 283 | |
| 439 | Nva-[Leu6; Lys(Pra)14; Glu28]JzTx-V(1-29) | 0.001374 | | | | |
| 439 | Nva-[Leu6; Lys(Pra)14; Glu28]JzTx-V(1-29) | 0.000384 | 0.2997 | | 781 | |
| 439 | Nva-[Leu6; Lys(Pra)14; Glu28]JzTx-V(1-29) | 0.000612 | | | | |
| 442 | Nva-[Leu6, Lys(Pra-NPEG3)14; Glu28]JzTx-V(1-29) | 0.004616 | 0.4514 | 3.96 | 98 | 857 |
| 449 | CyA-[Leu6, Lys(Pra)14, Glu28]JzTx-V(1-29) | 0.001496 | 0.1656 | 1.55 | 111 | 1038 |
| 520 | CyA-[Nle6; Pra11; Glu28]JzTx-V(1-29) | 0.000193 | 0.5170 | | 2673 | |
| 521 | CyA-[Nle6; Pra12; Glu28]JzTx-V(1-29) | 0.001476 | 0.0921 | | 62 | |
| 879 | [Nle6; Pra12; Glu28]JzTx-V(1-29) | 0.001354 | | | | |
| 686 | Pra-[Nle6; Phe20; Glu28]JzTx-V(1-29) | 0.010280 | | | | |
| 703 | Pra-[Nle6; Ala19; Glu28]JzTx-V(1-29) | >1.0 | | | | |
| 704 | Pra-[Nle6; Lys19; Glu28]JzTx-V(1-29) | >1.0 | | | | |
| 705 | Pra-[Nle6; Arg19; Glu28]JzTx-V(1-29) | >1.0 | | | | |

TABLE 12-continued

Electrophysiology by PatchXpress ® (PX) of JzTx-V analogs for conjugation.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| 718 | Pra-[Nle6; Lys17; Glu28]JzTx-V(1-29) | 0.001422 | 0.0339 | | 24 | |
| 728 | Pra-[Nle6; Glu12, 28; Lys17]JzTx-V(1-29) | 0.008758 | 0.4049 | | 46 | |
| 721 | Pra-[Nle6; Lys20; Glu28]JzTx-V(1-29) | 0.000519 | 0.1852 | | 357 | |
| 838 | Pra-[SeC2, 16; Nle6; Glu28]JzTx-V(1-29) | 0.000949 | 0.0581 | | 61 | |
| | Acidic Substitution Analogs | | | | | |
| 707 | Glu-Pra-[Nle6; Glu28]JzTx-V(1-29) | 0.000738 | 0.1119 | | 152 | |
| 709 | Pra-[Glu1, 28; Nle6]JzTx-V(1-29) | 0.001127 | 0.1851 | >1.0 | 164 | >887 |
| 712 | Pra-[Nle6; Glu8, 28]JzTx-V(1-29) | 0.016370 | 1.5820 | | 97 | |
| 714 | Pra-[Nle6; Glu11, 28]JzTx-V(1-29) | 0.001577 | 0.3808 | >10.0 | 241 | >6341 |
| 715 | Pra-[Nle6; Glu12, 28]JzTx-V(1-29) | 0.001726 | 0.8112 | >10.0 | 470 | >5794 |
| 717 | Pra-[Nle6; Glu14, 28]JzTx-V(1-29) | 0.000975 | 0.3252 | | 333 | |
| 719 | Pra-[Nle6; Glu18, 28]JzTx-V(1-29) | >1.0 | | | | |
| 720 | Pra-[Nle6; Glu19, 28]JzTx-V(1-29) | >1.0 | | | | |
| 722 | Pra-[Nle6; Glu22, 28]JzTx-V(1-29) | 0.022620 | >10.0 | | >442 | |
| 725 | Pra-[Nle6; Glu27, 28]JzTx-V(1-29) | >10.0 | | | | |
| 726 | Pra-[Nle6; Glu28]JzTx-V(1-29)-Glu | 0.032440 | | | | |
| 732 | CyA-[Nle6; Glu12, 28; Pra17]JzTx-V(1-29) | 0.000870 | 0.2528 | | 291 | |
| 733 | CyA-[Nle6; Glu14, 28; Pra17]JzTx-V(1-29) | 0.001189 | 0.1295 | | 109 | |
| 734 | Glu-Pra-[Nle6; Glu11, 28]JzTx-V(1-29) | 0.002329 | 1.0530 | | 452 | |
| 736 | Glu-[Pra1; Nle6; Glu11, 28]JzTx-V(1-29) | 0.001459 | 0.5468 | | 375 | |
| 738 | Glu-[Pra1; Nle6; Glu14, 28]JzTx-V(1-29) | 0.000563 | 0.2464 | | 437 | |
| 739 | Pra-[Glu1, 11, 28; Nle6]JzTx-V(1-29) | 0.005547 | 1.2790 | | 231 | |
| 741 | Glu-Pra-[Glu1, 11, 28; Nle6]JzTx-V(1-29) | 0.005587 | 1.6850 | | 302 | |
| 742 | Pra-[Glu1, 12, 28; Nle6]JzTx-V(1-29) | 0.004139 | 1.7200 | | 416 | |
| 743 | Pra-[Glu1, 14, 28; Nle6]JzTx-V(1-29) | 0.001356 | 0.6700 | | 494 | |
| 744 | Pra-[Nle6; Glu11, 12, 28]JzTx-V(1-29) | 0.003803 | 1.4220 | | 374 | |
| 748 | Glu-[Pra1; Nle6; Glu11, 12, 28]JzTx-V(1-29) | 0.006657 | 2.1510 | | 323 | |
| 750 | Glu-[Pra1; Nle6; Glu11, 14, 28]JzTx-V(1-29) | 0.002905 | 1.1940 | | 411 | |
| 751 | Pra-[Glu1, 11, 14, 28; Nle6]JzTx-V(1-29) | 0.010180 | 1.9240 | | 189 | |
| 756 | CyA-[Glu1, 12, 14, 28; Nle6; Pra17]JzTx-V(1-29) | >1.0 | | | | |
| 757 | CyA-[Glu1, 11, 12, 14, 28; Nle6; Pra17]JzTx-V(1-29) | >1.0 | | | | |
| 828 | Pra-[Nle6; Glu28]JzTx-V(1-29)-Gly-Free Acid | 0.008344 | 1.7610 | | 211 | |
| 772 | Glu-Nva-[Glu1, 11, 28; Nle6; Pra17]JzTx-V(1-29) | 0.015160 | | | | |
| 866 | CyA-[Glu1, 28; Nle6; Pra17; Cha29]JzTx-V(1-29) | 0.000321 | 0.0376 | | 117 | |
| 869 | CyA-[Glu1, 11, 28; Nle6; Pra17; Cha29]JzTx-V(1-29) | 0.00095 | 0.2943 | | 311 | |
| 1244 | CyA-[Nle6; Glu11; Pra17; 5-BrW24]JzTx-V(1-29) | 0.00064 | 0.0074 | | 12 | |
| 1672 | [CyA1; Nle6; Glu11, 28; Pra17]JzTx-V(1-29) | 0.00287 | 0.4567 | | 159 | |
| | Neutral Substitution Analogs | | | | | |
| 727 | Pra-[Nle6; Ala20; Glu28]JzTx-V(1-29) | 0.904600 | | | | |
| 795 | Pra-[Nle6; Cit20; Glu28]JzTx-V(1-29) | >1.0 | | | | |
| 799 | Pra-[Nle6; Cit20, 26; Glu28]JzTx-V(1-29) | 0.003697 | 0.3429 | | 93 | |
| 804 | Pra-[Nle6; Gln22; Glu28]JzTx-V(1-29) | 0.035330 | | | | |
| 807 | Pra-[Gln4; Nle6; Cit13; Glu28]JzTx-V(1-29) | 0.020930 | | | | |
| 1680 | [CyA1; Nle6; Pra17; Gln22; Glu28]JzTx-V(1-29) | 0.04764 | | | | |
| 1688 | [Pra1; Nle6; Val20; Glu28]JzTx-V(1-29) | 0.00399 | 1.1178 | | 280 | |
| | Hydrophobic Substitutions | | | | | |
| 841 | Pra-[1-Nal5; Nle6; Glu28]JzTx-V(1-29) | 0.070900 | | | | |
| 842 | Pra-[2-Nal5; Nle6; Glu28]JzTx-V(1-29) | 0.021650 | | | | |
| 844 | Pra-[hPhe5; Nle6; Glu28]JzTx-V(1-29) | 0.000599 | 0.2584 | | 431 | |
| 845 | Pra-[5-BrW5; Nle6; Glu28]JzTx-V(1-29) | 0.053520 | | | | |
| 863 | Pra-[Phe6; Glu28]JzTx-V(1-29) | 0.001360 | 0.0616 | | 45 | |
| 846 | Pra-[Nle6; 1-Nal7; Glu28]JzTx-V(1-29) | 0.825000 | | | | |
| 847 | Pra-[Nle6; 2-Nal7; Glu28]JzTx-V(1-29) | 0.470500 | | | | |
| 848 | Pra-[Nle6; Phe7; Glu28]JzTx-V(1-29) | 0.012640 | 1.0090 | | 80 | |
| 849 | Pra-[Nle6; hPhe7; Glu28]JzTx-V(1-29) | >1.0 | | | | |
| 850 | Pra-[Nle6; 5-BrW7; Glu28]JzTx-V(1-29) | 0.539600 | | | | |
| 855 | Pra-[Nle6; Ile23; Glu28]JzTx-V(1-29) | 0.001061 | 0.1934 | | 182 | |
| 856 | Pra-[Nle6, 23; Glu28]JzTx-V(1-29) | 0.001721 | 0.1021 | | 59 | |
| 857 | Pra-[Nle6; Nva23; Glu28]JzTx-V(1-29) | 0.003028 | | | | |
| 859 | Pra-[Nle6; Chg23; Glu28]JzTx-V(1-29) | 0.000489 | 0.1766 | | 361 | |
| 860 | Pra-[Nle6; Cha23; Glu28]JzTx-V(1-29) | 0.001614 | 0.1173 | | 73 | |
| 851 | Pra-[Nle6; 1-Nal24; Glu28]JzTx-V(1-29) | 0.031980 | | | | |
| 852 | Pra-[Nle6; 2-Nal24; Glu28]JzTx-V(1-29) | 0.182100 | | | | |
| 853 | Pra-[Nle6; Phe24; Glu28]JzTx-V(1-29) | 0.015290 | | | | |
| 854 | Pra-[Nle6; hPhe24; Glu28]JzTx-V(1-29) | >1.0 | | | | |
| 858 | Pra-[Nle6; 5-BrW24; Glu28]JzTx-V(1-29) | 0.000039 | 0.0404 | | 1036 | |
| 861 | Pra-[Nle6; Glu28; Phe29]JzTx-V(1-29) | 0.000388 | 0.3042 | | 785 | |
| 450 | Pra-[Nle6; Glu28; Trp29]JzTx-V(1-29) | 0.000782 | 0.0367 | | 47 | |
| 862 | Pra-[Nle6; Glu28; Cha29]JzTx-V(1-29) | 0.000593 | 0.0366 | | 62 | |
| 873 | CyA-[Nle6; Pra17; 6-BrW24; Glu28]JzTx-V(1-29) | 0.008471 | | | | |

TABLE 12-continued

Electrophysiology by PatchXpress ® (PX) of JzTx-V analogs for conjugation.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/ Nav1.7 | Nav1.5/ Nav1.7 |
|---|---|---|---|---|---|---|
| 874 | CyA-[Nle6; Pra17; 6-MeW24; Glu28]JzTx-V(1-29) | 0.014029 | | | | |
| 875 | CyA-[Nle6; Pra17; 7-BrW24; Glu28]JzTx-V(1-29) | 0.025289 | | | | |
| 876 | CyA-[Nle6; Pra17; Glu28; Phe29]JzTx-V(1-29) | 0.00109 | 0.0721 | | 66 | |
| 452 | CyA-[Nle6; Pra17; Glu28; Trp29]JzTx-V(1-29) | 0.00251 | 0.0646 | | 26 | |
| 877 | CyA-[Nle6; Pra17; Glu28; hPhe29]JzTx-V(1-29) | 0.00016 | 0.0149 | | 93 | |
| 1603 | Pra-[4-BrhE5; Nle6; Glu28]JzTx-V(1-29) | 0.00023 | 0.0479 | | 207 | |
| 1662 | CyA-[Nle6; Pra17; 5-MeW24; Glu28]JzTx-V(1-29) | 0.00052 | 0.0898 | | 172 | |
| 871 | Pra-[Nle6; 5-BrW24]JzTx-V(1-29) | 0.00166 | 0.0110 | | 7 | |
| 872 | CyA-[Nle6; Pra17; 5-BrW24]JzTx-V(1-29) | 0.00109 | 0.0036 | | 3 | |
| | Pra-containing [Glu20]JzTx-V analogs | | | | | |
| 297 | Pra-[Nle6; Glu20]JzTx-V(1-29) | 0.001867 | 0.8040 | 1.20 | 431 | 642 |
| 343 | [Pra1; Nle6; Glu20]JzTx-V(1-29) | 0.002633 | 0.7902 | 2.66 | 300 | 1011 |
| 344 | [Nle6; Pra11; Glu20]JzTx-V(1-29) | 0.018359 | 4.2172 | 3.55 | 230 | 193 |
| 345 | [Nle6; Pra14; Glu20]JzTx-V(1-29) | 0.007162 | 1.6607 | 4.57 | 232 | 638 |
| 346 | [Nle6; Pra17; Glu20]JzTx-V(1-29) | 0.009953 | 0.2906 | 1.02 | 29 | 102 |
| 393 | CyA-[Nle6, Lys(Pra)14, Glu20]JzTx-V(1-29) | >0.1 | >10 | | | |
| 396 | CyA-[Nle6, Pra17, Glu20]JzTx-V(1-29) | 0.002837 | 0.2779 | | 98 | |
| | Pra-containing [Glu20, Tyr28]JzTx-V analogs | | | | | |
| 313 | Pra-[Nle6; Glu20; Tyr28]JzTx-V(1-29) | 0.000427 | 0.9659 | 4.37 | 2261 | 10226 |
| 315 | [Nle6; Pra11; Glu20; Tyr28]JzTx-V(1-29) | 0.001284 | 0.8251 | 2.46 | 643 | 1914 |
| 316 | [Nle6; Pra14; Glu20; Tyr28]JzTx-V(1-29) | 0.001759 | 0.7069 | 3.69 | 402 | 2099 |
| 317 | [Nle6; Pra17; Glu20; Tyr28]JzTx-V(1-29) | 0.003802 | 0.6137 | 3.52 | 161 | 927 |
| 394 | CyA-[Nle6, Lys(Pra)14, Glu20, Tyr28]JzTx-V(1-29) | 0.000050 | 0.9641 | | 19130 | |
| 397 | CyA-[Nle6, Pra17, Glu20, Tyr28]JzTx-V(1-29) | 0.087101 | 1.7601 | | 20 | |
| 436 | Nva-[Nle6; Lys(Pra)14; Glu20; Tyr28]JzTx-V(1-29) | 0.002961 | | | | |
| 440 | Nva-[Leu6; Lys(Pra)14; Glu20; Tyr28]JzTx-V(1-29) | 0.001953 | | | | |
| | Pra-containing JzTx-V analogs | | | | | |
| 283 | [Nle6, Pra14]JzTx-V(1-29) | 0.000300* | 0.0050* | 0.63 | 17 | 2090 |
| 380 | CyA-[Nle6, Lys(Pra-NPEG3)14]JzTx-V(1-29) | 0.000885 | | | 0 | 0 |
| 380 | CyA-[Nle6, Lys(Pra-NPEG3)14]JzTx-V(1-29) | 0.000845 | | | | |
| 385 | CyA-[Nle6, Lys(Pra-NPEG3)17]JzTx-V(1-29) | 0.003636 | | | 0 | 0 |
| 431 | Nva-[Nle6, Lys(Pra)14]JzTx-V(1-29) | 0.001621 | 0.0205 | | 13 | |
| 431 | Nva-[Nle6, Lys(Pra)14]JzTx-V(1-29) | 0.001629 | | | | |
| 432 | Nva-[Nle6, Lys(Pra-NPEG3)14]JzTx-V(1-29) | 0.001432 | 0.0165 | | 12 | |
| 432 | Nva-[Nle6, Lys(Pra-NPEG3)14]JzTx-V(1-29) | 0.001556 | | | | |
| 438 | Nva-[Leu6, Lys(Pra)14]JzTx-V | 0.002379 | 0.0161 | | 7 | |
| 438 | Nva-[Leu6, Lys(Pra)14]JzTx-V | 0.001567 | | | | |
| 651 | Pra-[Nle6; Gly28]JzTx-V(1-29) | 0.003137 | | | | |
| 652 | Pra-[Nle6; His28]JzTx-V(1-29) | 0.000371 | | | | |
| 655 | Pra-[Nle6; Leu28]JzTx-V(1-29) | 0.002912 | 0.0259 | | 9 | |
| 657 | Pra-[Nle6; Pro28]JzTx-V(1-29) | 0.001969 | 0.2058 | | 105 | |
| 664 | Pra-[Nle6, 28]JzTx-V(1-29) | 0.000339 | | | | |
| 665 | Pra-[Nle6; Gln28]JzTx | 0.000912 | 0.0107 | 3.22 | 12 | 3529 |
| 682 | Pra-[Nle6; Tyr20]JzTx-V(1-29) | 0.005977 | | | | |
| 729 | Pra-[Nle6; Glu12; Lys17]JzTx-V(1-29) | 0.001872 | 0.0076 | | 4 | |
| 723 | Pra-[Nle6; Asp28]JzTx-V(1-29) | 0.005976 | 0.0784 | | 13 | |
| 730 | Pra-[Nle6; Glu12]JzTx-V(1-29) | 0.001189 | 0.0372 | | 31 | |
| 296 | Pra-[Nle6; Trp29]JzTx-V(1-29) | 0.004787 | 0.0370 | 2.29 | 8 | 479 |

* = at high concentrations, compound would wash off slowly or not at all.

TABLE 13

Electrophysiology by PatchXpress ® (PX) of JzTx-V peptide analogs with linkers.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/Nav1.7 | Nav1.5/Nav1.7 |
|---|---|---|---|---|---|---|
| 247 | Atz(NPEG10)-[Nle6]JzTx-V(1-29) | 0.006000* | 0.0080* | 3.77 | 1 | 629 |
| 248 | [Atz(NPEG10)1; Nle6]JzTx-V(1-29) | 0.001000* | 0.0150* | 0.95 | 15 | 946 |
| 256 | [Nle6; Atz(NPEG10)11]JzTx-V(1-29) | 0.009300* | 0.0270* | 1.86* | 3 | 200 |
| 270 | [Nle6; Atz(NPEG10)29]JzTx-V(1-29) | 0.022000 | | | | |
| 406 | [Nle6; Atz(NPEG10)17; Glu28]JzTx-V(1-29) | 0.005881 | 0.0659 | | 11 | |
| 407 | [Atz(NPEG10)1; Nle6; Glu20]JzTx-V(1-29) | 0.006480 | 0.5487 | | 85 | |
| 410 | CyA-[Nle6, Lys(Atz(NPEG10)-NPEG3)14]JzTx-V(1-29) | 0.006365 | 0.0166 | | 3 | |
| 433 | Nva-[Nle6, Lys(Atz(NPEG10))14]JzTx-V(1-29) | 0.004407 | 0.0148 | 1.27 | 6 | 288 |

TABLE 13-continued

Electrophysiology by PatchXpress ® (PX) of JzTx-V peptide analogs with linkers.

| SEQ ID NO. | Designation | PX hNav1.7 Tonic IC50 (μM) | PX hNav1.4 Tonic IC50 (μM) | PX hNav1.5 Tonic IC50 (μM) | Nav1.4/Nav1.7 | Nav1.5/Nav1.7 |
|---|---|---|---|---|---|---|
| 434 | Nva-[Nle6, Lys(Atz(NPEG10)-NPEG4)14]JzTx-V(1-29) | 0.009670 | 0.0513 | 0.95 | 8 | 98 |
| 443 | CyA-[Nle6, Atz(NPEG10)17, Glu28]JzTx-V(1-29) | 0.005625 | 0.1724 | 1.33 | 31 | 236 |
| 444 | CyA-[Nle6, Lys(Atz(NPEG10))14, Glu28]JzTx-V(1-29) | 0.005258 | 0.3834 | | 73 | |
| 445 | CyA-[Nle6, Lys(Atz(NPEG10))14, Glu20, Tyr28]JzTx-V(1-29) | 0.007112 | 1.2747 | | 179 | |
| 446 | Nva-[Leu6; Lys(Atz(NPEG10))14]JzTx-V(1-29) | 0.011649 | 0.1275 | 2.41 | 11 | 207 |
| 447 | Nva-[Leu6, Lys(Atz(NPEG10))14; Glu28]JzTx-V | 0.009001 | 0.4131 | 4.70 | 46 | 522 |
| 448 | Nva-[Nle6; Lys(Atz(NPEG10))14; Glu28]JzTx-V(1-29) | 0.018442 | 0.4433 | 4.18 | 24 | 227 |
| 427 | Atz(PEG11-benzylthioacetamide)-[Nle6DzTx-V(1-29) | 0.001400* | 0.0130* | 1.98* | 9 | 1416 |
| 883 | Atz(NPEG10)-[Nle6; Glu28]JzTx-V(1-29) | 0.003084 | 0.3714 | | 120 | |
| 886 | Atz(NPEG23)-[Nle6]JzTx-V(1-29) | 0.003091 | | | | |
| 891 | CyA-[Nle6, Lys(Atz(NPEG10))14, Glu28]JzTx-V(1-29) | 0.006093 | 0.4018 | 3.99 | 66 | 655 |
| 895 | CyA-[Nle6, Atz(palmitate)17, Glu28]JzTx-V(1-29) | 0.260400 | | | | |
| 896 | CyA-[Nle6, Atz(GGGGS-SA21-amide)17, Glu28]JzTx-V(1-29) | 0.298600 | | | | |
| 897 | CyA-[Nle6, Atz(His tag)17, Glu28]JzTx-V(1-29) | 0.034300 | | | | |
| 898 | Atz(Biotin)-[Nle6]JzTx-V(1-29) | 0.002483 | 0.0155 | 5.13 | 6 | 2067 |
| — | Homodimeric Conjugate No. 2 (see, Example 5) | 0.000200* | 0.0010* | 0.72* | 5 | 3595 |
| — | Homodimeric Conjugate No. 2 (see, Example 5) | 0.005920 | 0.0169 | 1.18 | 3 | 199 |
| — | Homodimeric Conjugate No. 6 (see, Example 5) | 0.000414 | | | | |
| — | Homodimeric Conjugate No. 7 (see, Example 5) | 0.002121 | 0.2004 | | 94 | |
| — | Homodimeric Conjugate No. 8 (see, Example 5) | 0.000679 | 0.0526 | 1.53 | 77 | 2246 |
| — | Homodimeric Conjugate No. 9 (see, Example 5) | 0.001319 | 0.1184 | 1.69 | 90 | 1283 |
| — | Immunoglobulin Peptide Conjugate 1 (see, Example 9, Table 21) | 0.002900 | 0.0024 | | | |
| — | Immunoglobulin Peptide Conjugate 1 (see, Example 9, Table 21) | 0.0023 | 0.0052 | 0.623 | 2 | 0.623 |
| — | Immunoglobulin Peptide Conjugate 2 (see, Example 9, Table 21) | 0.001 | 0.1153 | | 115 | |
| — | Immunoglobulin Peptide Conjugate 3 (see, Example 9, Table 21) | 0.0023 | 0.076 | 2.69 | 33 | 2.69 |
| — | Immunoglobulin Peptide Conjugate 4 (see, Example 9, Table 21) | 0.002 | 0.0724 | | 36 | |
| — | Immunoglobulin Peptide Conjugate 5 (see, Example 9, Table 21) | 0.0078 | 0.166 | | 21 | |
| — | Immunoglobulin Peptide Conjugate 6 (see, Example 9, Table 21) | 0.041 | | | 0 | |
| — | Immunoglobulin Peptide Conjugate 7 (see, Example 9, Table 21) | 0.0746 | 0.62 | 4.07 | 8 | 4.07 |
| — | Immunoglobulin Peptide Conjugate 8 (see, Example 9, Table 21) | 0.075 | 0.948 | | 13 | |
| — | Immunoglobulin Peptide Conjugate 9 (see, Example 9, Table 21) | 0.0397 | 0.112 | 9.82 | 3 | 9.82 |
| — | Immunoglobulin Peptide Conjugate 10 (see, Example 9, Table 21) | 0.046 | 0.344 | >10 | 7 | >10 |
| — | Immunoglobulin Peptide Conjugate 11 (see, Example 9, Table 21) | 0.045 | | | | |
| — | Immunoglobulin Peptide Conjugate 12 (see, Example 9, Table 21) | 0.003 | 0.1271 | | 42 | |
| — | Immunoglobulin Peptide Conjugate 13 (see, Example 9, Table 21) | 0.01 | | | | |
| — | Immunoglobulin Peptide Conjugate 14 (see, Example 9, Table 21) | 0.0017 | 0.0984 | | 58 | |
| — | Immunoglobulin Peptide Conjugate 15 (see, Example 9, Table 21) | 0.125 | | | | |
| — | Immunoglobulin Peptide Conjugate 16 (see, Example 9, Table 21) | 0.27 | | | | |
| — | Immunoglobulin Peptide Conjugate 17 (see, Example 9, Table 21) | 0.0026 | | | | |
| — | Immunoglobulin Peptide Conjugate 18 (see, Example 9, Table 21) | 0.0077 | | | | |
| — | Immunoglobulin Peptide Conjugate 19 (see, Example 9, Table 21) | 0.282 | | | | |
| — | Immunoglobulin Peptide Conjugate 20 (see, Example 9, Table 21) | 0.099520 | | | | |
| — | Immunoglobulin Peptide Conjugate 21 (see, Example 9, Table 21) | 0.028360 | 0.4181 | | 15 | |
| — | Immunoglobulin Peptide Conjugate 22 (see, Example 9, Table 21) | 0.30761 | 3.6406 | | 12 | |
| — | HSA Peptide Conjugate 2 (see, Example 11, Table 23) | 0.072900 | | | | |

* = at high concentrations, compound would wash off slowly or not at all.

TABLE 14

Manual Electrophysiology by Whole Cell Patch Clamp (WCPC) of JzTx-V and JzTx-V Analogs.

| SEQ ID NO. | Designation | Fully non-inactivated Mean IC50 (nM) | Fully non-inactivated 1.x/1.7 | Partially inactivated Mean IC50 (nM) | Partially inactivated 1.x/1.7 | n | Channel type |
|---|---|---|---|---|---|---|---|
| 2 | JzTx-V(1-29) | 0.1415 | 1 | 0.1615 | 1 | 2 | hNav1.7 |
| 2 | JzTx-V(1-29) | 14 | 99 | 12.25 | 76 | 2 | hNav1.3 |
| 2 | JzTx-V(1-29) | 10.6 | 75 | 9.35 | 58 | 2 | hNav1.4 |
| 2 | JzTx-V(1-29) | 881.5 | 6230 | 426.5 | 2641 | 2 | hNav1.5 |
| 2 | JzTx-V(1-29) | 810 | 5724 | 530 | 3282 | 2 | hNav1.8 |
| 2 | JzTx-V(1-29) | 75 | 530 | 18 | 111 | 2 | mTTX-S |
| 2 | JzTx-V(1-29) | >>1000 | | >>1000 | | 2 | mTTX-R |
| 112 | [Glu20, Trp29]JzTx-V(1-29) | | | 279 | 1213 | 2 | mTTX-S (cultured DRG) |
| 112 | [Glu20, Trp29]JzTx-V(1-29) | | | 211 | 917 | 2 | mTTX-S (fresh DRG) |
| 112 | [Glu20, Trp29]JzTx-V(1-29) | | | 0.23 | 1 | 2 | hNav1.7 |
| 112 | [Glu20, Trp29]JzTx-V(1-29) | | | 261 | 1135 | 2 | rTTX-S |
| 425 | Pra-[Nle6]JzTx-V(1-29) | | | 5.35 | 6335 | 2 | mTTX-S |
| 425 | Pra-[Nle6]JzTx-V(1-29) | 0.0004085 | 1 | 0.0008445 | 1 | 2 | hNav1.7 |
| 392 | CyA-[Nle6, Lys(Pra)14, Glu28]JzTx-V(1-29) | | | 46.6 | | 2 | mTTX-S |
| 395 | CyA-[Nle6, Pra17, Glu28]JzTx-V(1-29) | | | 15.9 | | 2 | mTTX-S |
| 395 | CyA-[Nle6, Pra17, Glu28]JzTx-V(1-29) | | | 9.25 | | 2 | rTTX-S |
| 328 | Pra-[Nle6, Glu28]JzTx-V(1-29) | | | 0.62 | | 2 | hNav1.7 |
| 328 | Pra-[Nle6, Glu28]JzTx-V(1-29) | | | 27.2 | 44 | 2 | hNav1.1 |
| 328 | Pra-[Nle6, Glu28]JzTx-V(1-29) | | | 44.4 | 72 | 2 | hNav1.2 |
| 328 | Pra-[Nle6, Glu28]JzTx-V(1-29) | | | 52.51 | 85 | 2 | hNav1.3 |
| 328 | Pra-[Nle6, Glu28]JzTx-V(1-29) | | | 74.6 | 120 | 2 | hNav1.4 |
| 328 | Pra-[Nle6, Glu28]JzTx-V(1-29) | | | >1000 | >1613 | 2 | hNav1.5 |
| 328 | Pra-[Nle6, Glu28]JzTx-V(1-29) | | | 19.45 | 31 | 2 | hNav1.6 |
| 328 | Pra-[Nle6, Glu28]JzTx-V(1-29) | | | >1000 | >1613 | 2 | hNav1.8 |
| 328 | Pra-[Nle6, Glu28]JzTx-V(1-29) | | | 11.2 | 18 | 2 | mTTX-S |
| 328 | Pra-[Nle6, Glu28]JzTx-V(1-29) | | | 30.7 | 50 | 2 | rTTX-S |
| 443 | CyA-[Nle6, Atz(NPEG10)17, Glu28]JzTx-V(1-29) | | | 35.25 | | 2 | mTTX-S |
| 858 | Pra-[Nle6; 5-BrW24; Glu28]JzTx-V(1-29) | | | 0.1303 | | 2 | hNav1.7 |
| 858 | Pra-[Nle6; 5-BrW24; Glu28]JzTx-V(1-29) | | | 3.8 | 29 | 2 | mTTX-S |
| 715 | Pra-[Nle6; Glu12, 28]JzTx-V(1-29) | | | 144.5 | | 2 | mTTX-S |
| 717 | Pra-[Nle6; Glu14, 28]JzTx-V(1-29) | | | 99.75 | | 2 | mTTX-S |
| — | Immunoglobulin Peptide Conjugate 3 (see, Example 9, Table 21) | | | 30 | | 2 | mTTX-S |
| — | Immunoglobulin Peptide Conjugate 5 (see, Example 9, Table 21) | | | 62 | | 2 | mTTX-S |
| — | Immunoglobulin Peptide Conjugate 7 (see, Example 9, Table 21) | | | 65 | | 2 | mTTX-S |
| — | Immunoglobulin Peptide Conjugate 8 (see, Example 9, Table 21) | | | 608 | | 2 | mTTX-S |

TABLE 15

Electrophysiology by PATCHXPRESS ® (PX) patch clamp system of JzTx-V peptide analogs: Nav1.6.

| SEQ ID NO. | Designation | PX hNav1.7 Tonic IC50 (uM) | PX hNav1.6 Tonic IC50 (uM) | Nav1.6/Nav1.7 |
|---|---|---|---|---|
| 54 | [Glu7]JzTx-V(1-29) | | >10.0 | |
| 57 | [Glu11]JzTx-V(1-29) | | 0.2005 | |
| 60 | [Glu14]JzTx-V(1-29) | | 0.1457 | |
| 65 | [Glu23]JzTx-V(1-29) | | 9.546 | |
| 69 | [Glu28]JzTx-V(1-29) | 0.000568 | 0.2482 | 437 |
| 70 | [Glu29]JzTx-V(1-29) | 0.261300 | >10.0 | >38 |
| 112 | [Glu20,Trp29]JzTx-V | 0.001587 | 0.7198 | 454 |
| 328 | Pra-[Nle6,Glu28]JzTx-V(1-29) | 0.000548 | 0.18315 | 334 |
| 392 | CyA-[Nle6,Lys(Pra)14,Glu28]JzTx-V(1-29) | 0.001592 | 0.2495 | 157 |
| 395 | CyA-[Nle6,Pra17,Glu28]JzTx-V(1-29) | 0.000779 | 0.07318 | 94 |
| 425 | Pra-[Nle6]JzTx-V | 0.001197 | 0.06794 | 57 |
| 718 | Pra-[Nle6;Lys17;Glu28]JzTx-V(1-29) | 0.001422 | 0.1479 | 104 |
| 721 | Pra-[Nle6;Lys20;Glu28]JzTx-V(1-29) | 0.000519 | 0.2446 | 471 |
| 51 | [Glu4]JzTx-V(1-29) | 0.846700 | >10.0 | >12 |
| 708 | Glu-[Nle6;Glu28]JzTx-V(1-29) | 0.000765 | 0.5215 | 682 |
| 723 | Pra-[Nle6;Asp28]JzTx-V(1-29) | 0.005976 | 1.616 | 270 |
| 707 | Glu-Pra-[Nle6;Glu28]JzTx-V(1-29) | 0.000738 | 0.1742 | 236 |

TABLE 15-continued

| Electrophysiology by PATCHXPRESS ® (PX) patch clamp system of JzTx-V peptide analogs: Nav1.6. | | | | |
|---|---|---|---|---|
| SEQ ID NO. | Designation | PX hNav1.7 Tonic IC50 (uM) | PX hNav1.6 Tonic IC50 (uM) | Nav1.6/Nav1.7 |
| 709 | Pra-[Glu1,28;Nle6]JzTx-V(1-29) | 0.001127 | 0.584 | 518 |
| 712 | Pra-[Nle6;Glu8,28]JzTx-V(1-29) | 0.016370 | 6.459 | 395 |
| 714 | Pra-[Nle6;Glu11,28]JzTx-V(1-29) | 0.001577 | 1.163 | 737 |
| 715 | Pra-[Nle6;Glu12,28]JzTx-V(1-29) | 0.001726 | 0.877 | 508 |
| 717 | Pra-[Nle6;Glu14,28]JzTx-V(1-29) | 0.000975 | 2.494 | 2558 |
| 720 | Pra-[Nle6;Glu19,28]JzTx-V(1-29) | >1.0 | >10.0 | |
| 722 | Pra-[Nle6;Glu22,28]JzTx-V(1-29) | 0.022620 | >10.0 | >442 |
| 732 | CyA-[Nle6;Glu12,28;Pra17]JzTx-V(1-29) | 0.000870 | 1.715 | 1972 |
| 733 | CyA-[Nle6;Glu14,28;Pra17]JzTx-V(1-29) | 0.001189 | 0.1747 | 147 |
| 734 | Glu-Pra-[Nle6;Glu11,28]JzTx-V(1-29) | 0.002329 | 2.872 | 1233 |
| 736 | Glu-[Pra1;Nle6;Glu11,28]JzTx-V(1-29) | 0.001459 | 2.524 | 1730 |
| 738 | Glu-[Pra1;Nle6; Glu14,28]JzTx-V(1-29) | 0.000525 | 0.5625 | 1071 |
| 739 | Pra-[Glu1,11,28;Nle6]JzTx-V(1-29) | 0.005547 | 2.19 | 395 |
| 741 | Glu-Pra-[Glu1,11,28;Nle6]JzTx-V(1-29) | 0.005587 | 5.663 | 1014 |
| 742 | Pra-[Glu1,12,28;Nle6]JzTx-V(1-29) | 0.004139 | 1.378 | 333 |
| 743 | Pra-[Glu1,14,28;Nle6]JzTx-V(1-29) | 0.001356 | 2.342 | 1727 |
| 744 | Pra-[Nle6;Glu11,12,28]JzTx-V(1-29) | 0.003803 | 0.8251 | 217 |
| 748 | Glu-[Pra1;Nle6;Glu11,12,28]JzTx-V(1-29) | 0.006657 | 2.732 | 410 |
| 750 | Glu-[Pra1;Nle6; Glu11,14,28]JzTx-V(1-29) | 0.002905 | >10.0 | >3442 |
| 727 | Pra-[Nle6;Ala20;Glu28]JzTx-V(1-29) | 0.904600 | >10.0 | >11 |
| 844 | Pra-[hPhe5;Nle6;Glu28]JzTx-V(1-29) | 0.000599 | 0.9982 | 1666 |
| 858 | Pra-[Nle6;5-BrW24;Glu28]JzTx-V(1-29) | 0.000059 | 0.04924 | 829 |
| — | Immunoglobulin Peptide Conjugate 3 (see, Example 9, Table 21) | 0.0023 | 0.3534 | 154 |
| — | Immunoglobulin Peptide Conjugate 5 (see, Example 9, Table 21) | 0.0078 | 2.4121 | 309 |
| — | Immunoglobulin Peptide Conjugate 7 (see, Example 9, Table 21) | 0.0746 | 8.2024 | 110 |
| — | Immunoglobulin Peptide Conjugate 8 (see, Example 9, Table 21) | 0.075 | 4.6704 | 62 |

TABLE 16

| Electrophysiology by PatchXpress ® (PX) of JzTx-V peptide analogs: Rodent Nav. | | | | | | | | |
|---|---|---|---|---|---|---|---|---|
| SEQ ID NO. | Designation | PX hNav1.7 Tonic IC50 (uM) | PX rNav1.7 Tonic IC50 (uM) | rNav1.7/ hNav1.7 | PX mNav1.7 Tonic IC50 (uM) | mNav1.7/ hNav1.7 | PX mNav1.4 Tonic IC50 (uM) | mNav1.4/ mNav1.7 |
| 112 | [Glu20, Trp29]JzTx-V | 0.001587 | 0.001303 | 0.82 | 0.005077 | 3.20 | | |
| 247 | Atz(NPEG9)-[Nle6]JzTx-V(1-29) | 0.004300 | 0.000961 | 0.22 | 0.007106 | 1.65 | | |
| 328 | Pra-[Nle6, Glu28]JzTx-V(1-29) | 0.000548 | 0.000641 | 1.17 | 0.009858 | 17.99 | 0.11925 | 12 |
| 361 | Leu-[Nle6]JzTx-V(1-29) | 0.000130 | | | 0.001329 | 10.22 | 0.00180 | 1.4 |
| 364 | Trp-[Nle6]JzTx-V(1-29) | 0.000330 | | | 0.001343 | 4.07 | | |
| 366 | CyA-[Nle6]JzTx-V(1-29) | 0.000310 | | | 0.000957 | 3.09 | | |
| 369 | Nva-[Nle6]JzTx-V(1-29) | 0.000820 | | | | | 0.00454 | |
| 373 | D-Leu-[Nle6]JzTx-V(1-29) | 0.000150 | | | 0.012600 | 84.00 | | |
| 375 | Sar-[Nle6]JzTx-V(1-29) | 0.000320 | | | 0.003445 | 10.77 | | |
| 392 | CyA-[Nle6, Lys(Pra)14, Glu28] JzTx-V(1-29) | 0.001592 | 0.002729 | 1.71 | 0.009788 | 6.15 | 0.06275 | 6.4 |
| 395 | CyA-[Nle6, Pra17, Glu28]JzTx-V(1-29) | 0.000779 | 0.001412 | 1.81 | 0.004804 | 6.16 | 0.03217 | 6.7 |
| 425 | Pra-[Nle6]JzTx-V | 0.001197 | 0.000522 | 0.44 | 0.000511 | 0.43 | 0.00018 | 0.35 |
| 443 | CyA-[Nle6, Atz(NPEG10)17, Glu28]JzTx-V(1-29) | 0.011715 | 0.005447 | 0.46 | 0.026100 | 2.23 | | |
| 729 | Pra-[Nle6; Glu12; Lys17]JzTx-V(1-29) | 0.001872 | 0.000653 | 0.35 | 0.001270 | 0.68 | 0.00277 | 2.2 |
| 728 | Pra-[Nle6; Glu12, 28; Lys17]JzTx-V(1-29) | 0.008758 | 0.002014 | 0.23 | 0.004400 | 0.50 | 0.06301 | 14 |
| 730 | Pra-[Nle6; Glu12]JzTx-V(1-29) | 0.001189 | 0.000580 | 0.49 | 0.000610 | 0.51 | 0.00636 | 10 |
| 709 | Pra-[Glu1, 28; Nle6]JzTx-V(1-29) | 0.001127 | 0.001378 | 1.22 | 0.009482 | 8.41 | 0.25940 | 27 |
| 714 | Pra-[Nle6; Glu11, 28]JzTx-V(1-29) | 0.001577 | 0.001500 | 0.95 | 0.016670 | 10.57 | 0.56510 | 34 |
| 715 | Pra-[Nle6; Glu12, 28]JzTx-V(1-29) | 0.001726 | 0.002661 | 1.54 | 0.016160 | 9.37 | 0.54780 | 34 |
| 296 | Pra-[Nle6; Trp29]JzTx-V(1-29) | 0.004787 | | | 0.010680 | 2.23 | 0.00967 | 0.91 |
| 886 | Atz(NPEG23)-[Nle6]JzTx-V(1-29) | 0.003091 | | | 0.006910 | 2.24 | | |
| 891 | CyA-[Nle6, Lys(Atz(NPEG10))14, Glu28]JzTx-V(1-29) | 0.006093 | 0.008696 | 1.43 | 0.036140 | 5.93 | | |
| 330 | [Nle6; Pra11; Glu28]JzTx-V(1-29) | 0.000473 | 0.003834 | 8.10 | 0.003693 | 7.81 | | |
| 738 | Glu-[Pra1; Nle6; Glu14, 28]JzTx-V(1-29) | 0.000563 | 0.003345 | 5.94 | 0.016131 | 28.63 | | |
| 858 | Pra-[Nle6; 5-BrW24; Glu28]JzTx-V(1-29) | 0.000039 | 0.002429 | 62.26 | 0.000911 | 23.34 | | |
| 859 | Pra-[Nle6; Chg23; Glu28]JzTx-V(1-29) | 0.000489 | 0.003267 | 6.68 | 0.000884 | 1.81 | | |
| 861 | Pra-[Nle6; Glu28; Phe29]JzTx-V(1-29) | 0.000388 | 0.000296 | 0.76 | 0.003450 | 8.90 | | |

TABLE 16-continued

Electrophysiology by PatchXpress ® (PX) of JzTx-V peptide analogs: Rodent Nav.

| SEQ ID NO. | Designation | PX hNav1.7 Tonic IC50 (uM) | PX rNav1.7 Tonic IC50 (uM) | rNav1.7/ hNav1.7 | PX mNav1.7 Tonic IC50 (uM) | mNav1.7/ hNav1.7 | PX mNav1.4 Tonic IC50 (uM) | mNav1.4/ mNav1.7 |
|---|---|---|---|---|---|---|---|---|
| 450 | Pra-[Nle6; Glu28; Trp29]JzTx-V(1-29) | 0.000352 | 0.000097 | 0.27 | 0.003108 | 8.82 | | |
| 520 | CyA-[Nle6; Pra11; Glu28]JzTx-V(1-29) | 0.000193 | 0.002239 | 11.58 | 0.004037 | 20.87 | | |
| — | Homodimeric Conjugate No. 8 (see, Example 5) | 0.000679 | 0.002101 | 3.09 | 0.000593 | 0.87 | | |
| — | Homodimeric Conjugate No. 9 (see, Example 5) | 0.001319 | 0.003605 | 2.73 | 0.005318 | 4.03 | | |
| — | Immunoglobulin Peptide Conjugate 1 (see, Example 9, Table 21) | 0.0023 | 0.0022 | 1 | | | | |
| — | Immunoglobulin Peptide Conjugate 2 (see, Example 9, Table 21) | 0.001 | 0.0027 | 2.7 | | | | |
| — | Immunoglobulin Peptide Conjugate 3 (see, Example 9, Table 21) | 0.0023 | 0.0033 | 1.4 | 0.0047 | 2 | 0.365 | 78 |
| — | Immunoglobulin Peptide Conjugate 4 (see, Example 9, Table 21) | 0.002 | 0.0036 | 1.8 | | | | |
| — | Immunoglobulin Peptide Conjugate 7 (see, Example 9, Table 21) | 0.0746 | | | 0.17 | 2.3 | | |
| — | Immunoglobulin Peptide Conjugate 8 (see, Example 9, Table 21) | 0.075 | | | 0.3065 | 4 | | |
| — | Immunoglobulin Peptide Conjugate 12 (see, Example 9, Table 21) | 0.003 | 0.0021 | 0.7 | | | | |
| — | Immunoglobulin Peptide Conjugate 14 (see, Example 9, Table 21) | 0.0017 | 0.0024 | 1.4 | | | | |
| — | HSA Peptide Conjugate 2 (see, Example 11, Table 23) | 0.0729 | 0.0415 | 0.57 | 0.1791 | 2.46 | | |

Example 4: Plasma Stability Studies

The stability of JzTx-V peptide analogs were studied in human, cynomolgus monkey ("cyno"), rat and mouse plasmas. Peptide stock solutions were made from JzTx-V peptide analog reference standards in 50/50 (v/v) methanol/water and stored at −20° C. 1 mg/mL peptide stock solutions were used to prepare 20 μg/mL peptide working solutions in HPLC grade water. The peptide working solutions were stored in a refrigerator at 2 to 8° C. prior to use.

Stability samples were prepared by adding 225 μl plasma into the vials containing 25 μl of 20 μg/mL peptide working solutions and were incubated at 37° C. The initial concentration was 2 μg/mL for each peptide in human, rat, or mouse plasma. 25 μl plasma samples at five time points (0, 2, 4, 8 and 24 hours) were aliquoted into the appropriate well of a 96-well plate, followed by the addition of 25 μl of internal standard solution (100 ng/mL, peptide analog made in 50/50 methanol/water) and 100 μL of 0.1% formic acid and the samples were vortex mixed. An Oasis HLB μElution 96-well solid phase extraction plate was used to extract JzTx-V peptide analog peptides from the pretreated plasma samples and the extracts were injected (10 μL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH $C_{18}$ 2.1 mm×50 mm column. The mobile phases were 0.1% formic acid in acetonitrile/water (5/95, v/v, mobile phase A) and 0.1% formic acid in acetonitrile/water (95/5, v/v, mobile phase B). Data was collected and processed using AB Sciex Analyst® software (version 1.5).

The plasma stability of the tested peptides were derived from the peak area ratios corresponding to peptides and internal standard obtained from the LC-MS/MS analysis, all data were normalized to the value at 0-hr time point. Results are shown in Table 17, Table 18, Table 19, and Table 20, below. JzTx-V peptide analogs tested showed remarkable stability in human, cyno, mouse, and rat plasma, likely due to their compact, disulfide-stabilized structure.

TABLE 17

Stability of JzTx-V peptide analogs in human plasma.

| | % Peptide Remaining | |
|---|---|---|
| Incubation Time (hr) | [Glu20,Trp29]JzTx-V(1-29); SEQ ID No. 112 | [Glu20,Ser28]JzTx-V(1-29); SEQ ID No. 138 |
| 0 | 100 | 100 |
| 2 | 95 | 86 |
| 4 | 84 | 82 |
| 6 | 75 | 72 |
| 8 | 71 | 68 |
| 24 | 48 | 49 |

TABLE 18

Stability of JzTx-V peptide analogs in cyno plasma.

| | % Peptide Remaining | |
|---|---|---|
| Incubation Time (hr) | [Glu20,Trp29]JzTx-V(1-29); SEQ ID No. 112 | [Glu20,Ser28]JzTx-V(1-29); SEQ ID No. 138 |
| 0 | 100 | 100 |
| 2 | 93 | 78 |
| 4 | 91 | 75 |
| 6 | 90 | 69 |
| 8 | 91 | 62 |
| 24 | 89 | 59 |

TABLE 19

Stability of JzTx-V peptide analogs in mouse plasma.

| Incubation Time (hr) | % Peptide Remaining [Glu20,Trp29]JzTx-V(1-29); SEQ ID No. 112 | [Glu20,Ser28]JzTx-V(1-29); SEQ ID No. 138 |
|---|---|---|
| 0 | 100 | 100 |
| 2 | 88 | 64 |
| 4 | 82 | 61 |
| 6 | 85 | 55 |
| 8 | 85 | 51 |
| 24 | 77 | 50 |

TABLE 20

Stability of JzTx-V peptide analogs in rat plasma.

| Incubation Time (hr) | % Peptide Remaining [Glu20,Trp29]JzTx-V(1-29); SEQ ID No. 112 | [Glu20,Ser28]JzTx-V(1-29); SEQ ID No. 138 |
|---|---|---|
| 0 | 100 | 100 |
| 2 | 95 | 90 |
| 4 | 93 | 81 |
| 6 | 92 | 71 |
| 8 | 89 | 67 |
| 24 | 70 | 59 |

Example 5: PEGylated Conjugates of JzTx-V Peptide Analogs Studies

Figure 2:
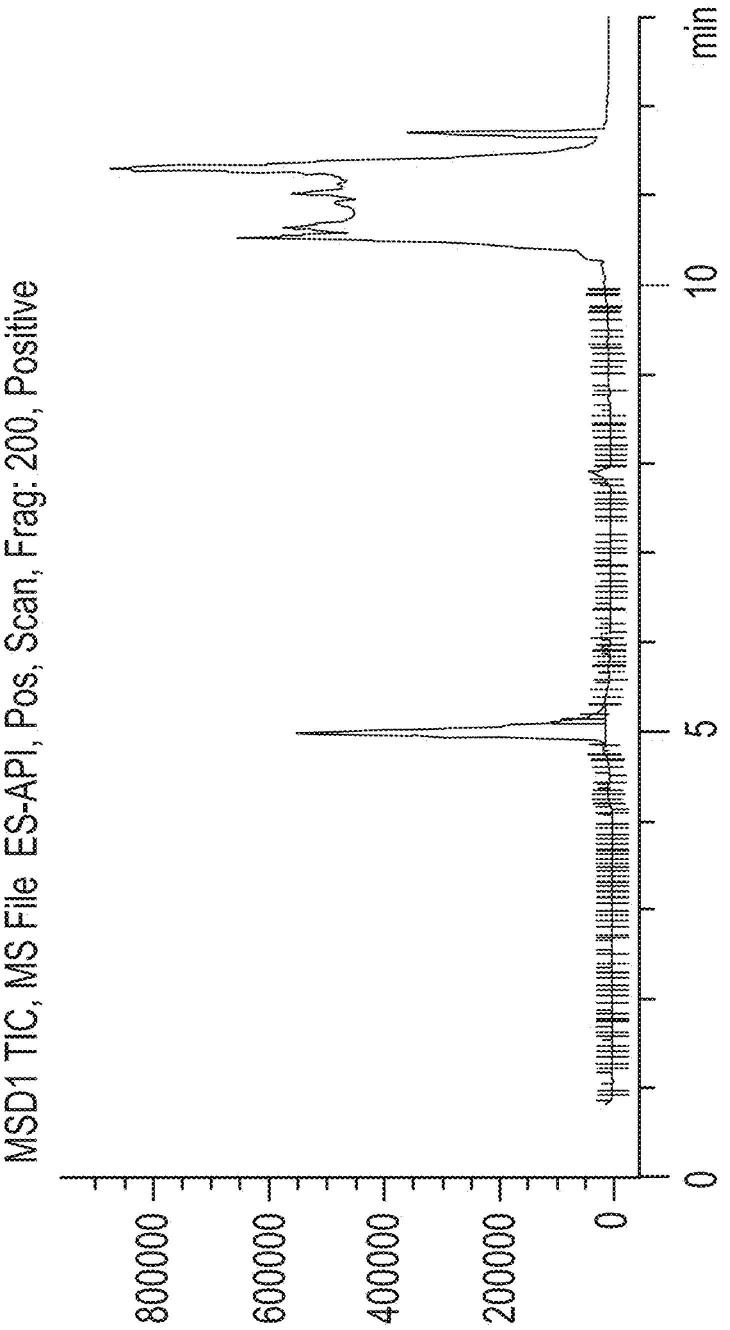
FIG. 2 shows the total ion count (TIC) chromatogram of the ESI-MS detector from the LC-MS analysis of synthetic JzTx-V(1-29) (SEQ ID NO:2).
Figure 3:
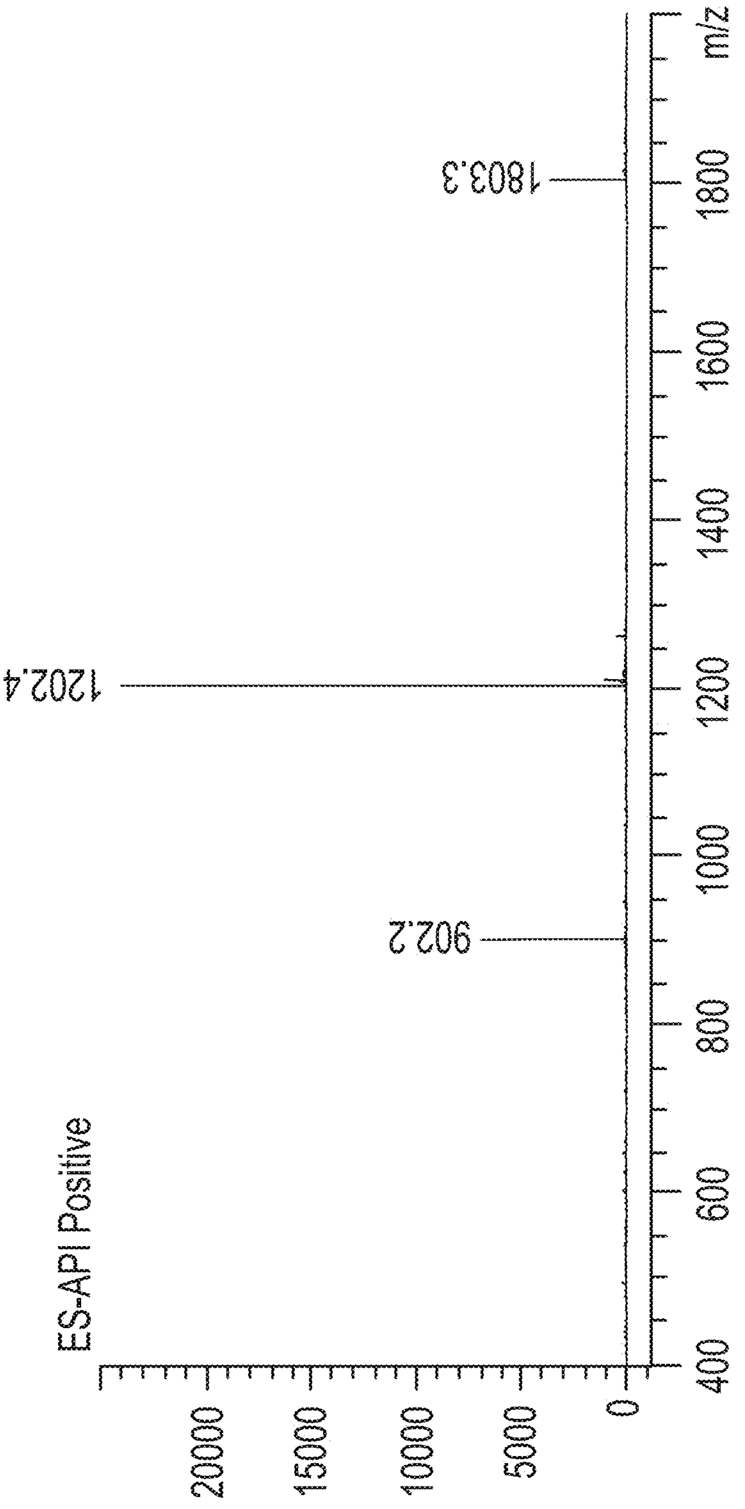
FIG. 3 shows the ESI-MS analysis of the peak with the retention time ($r_t$) of 4.95 minutes in FIG. 2. The peaks with m/z ratios of 1803.3, 1202.4, and 902.2 represent the $[M+2H]^{2+}$, $[M+3H]^{3+}$ and $[M+4H]^{4+}$ charge states, respectively, of JzTx-V(1-29), which has an average molecular weight of 3605.36 Da.
Figure 75A:
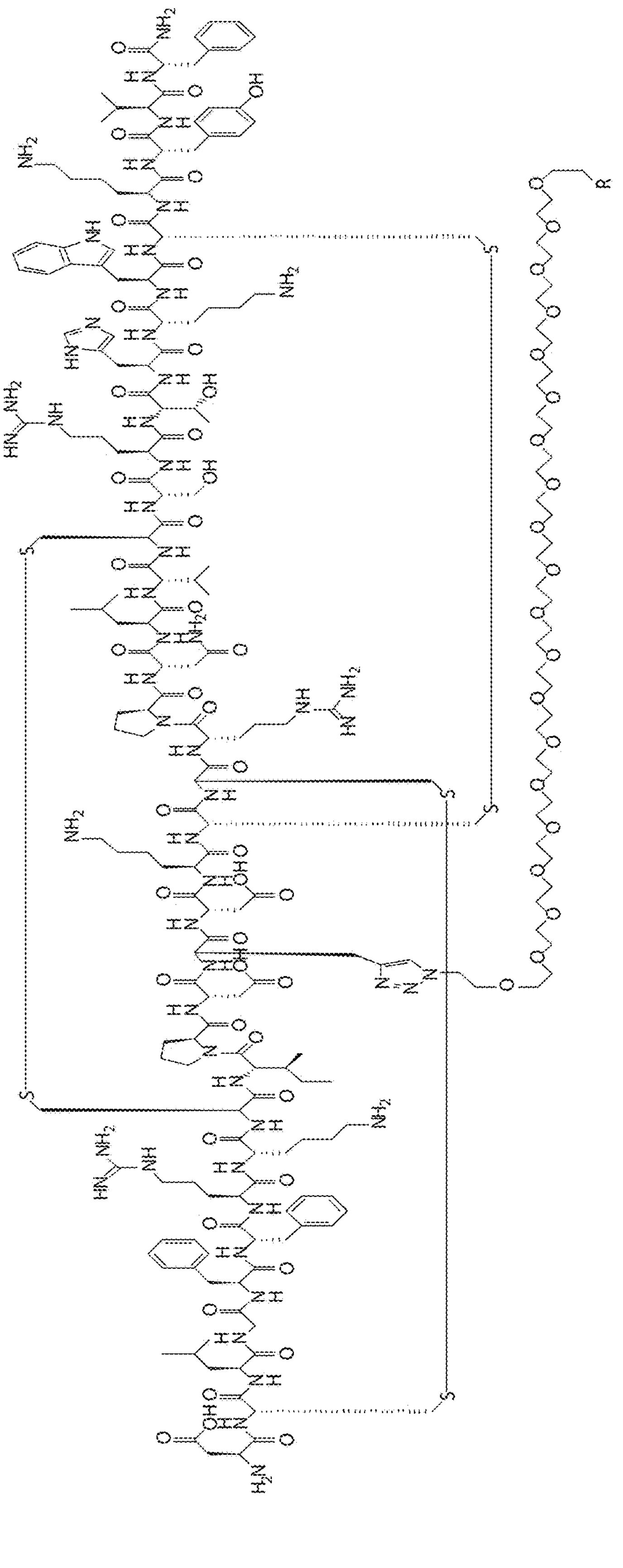
FIG. 75A-B shows the chemical structure of peptide dimer Homodimeric Conjugate No. 3.
Figure 75B:
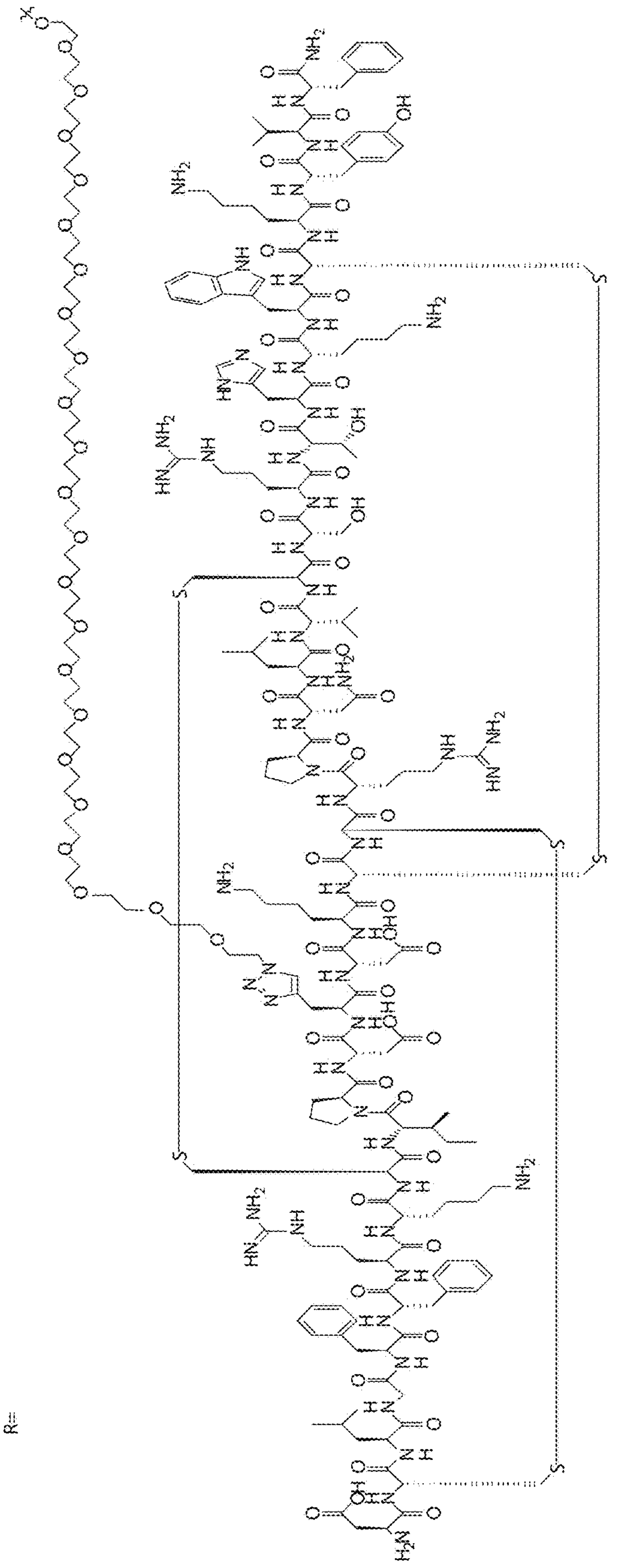
Figures 1, 81A:
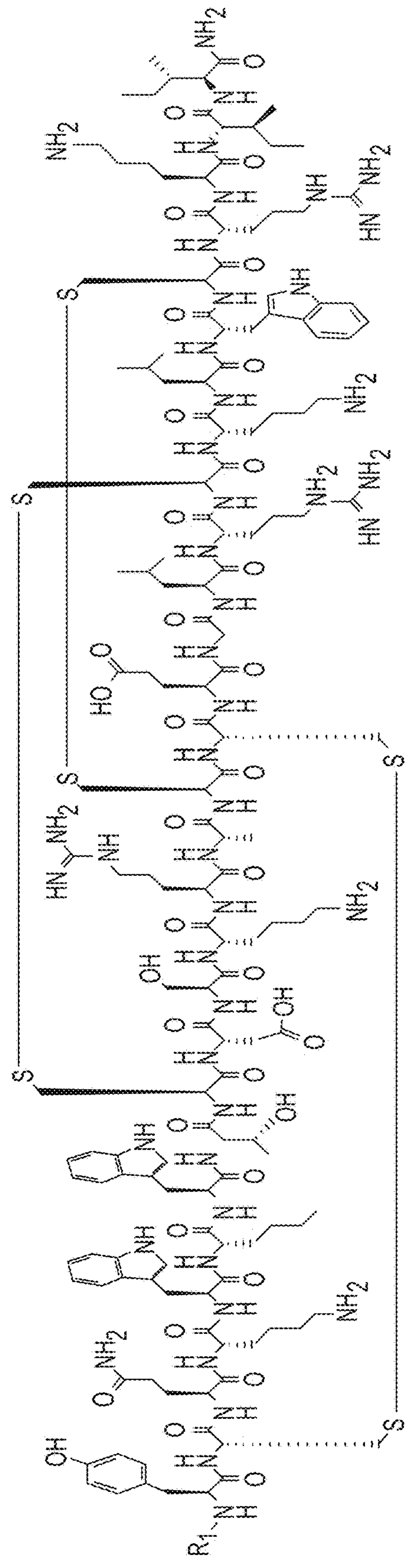
FIG. 81A-C shows chemical structures of JzTx-V peptide analog SEQ ID NO:272 (FIG. 81A-1, upper row: i.e., $R_1$=H), plus a peptide linker sequence (SEQ ID NO:427.
Figure 81B:
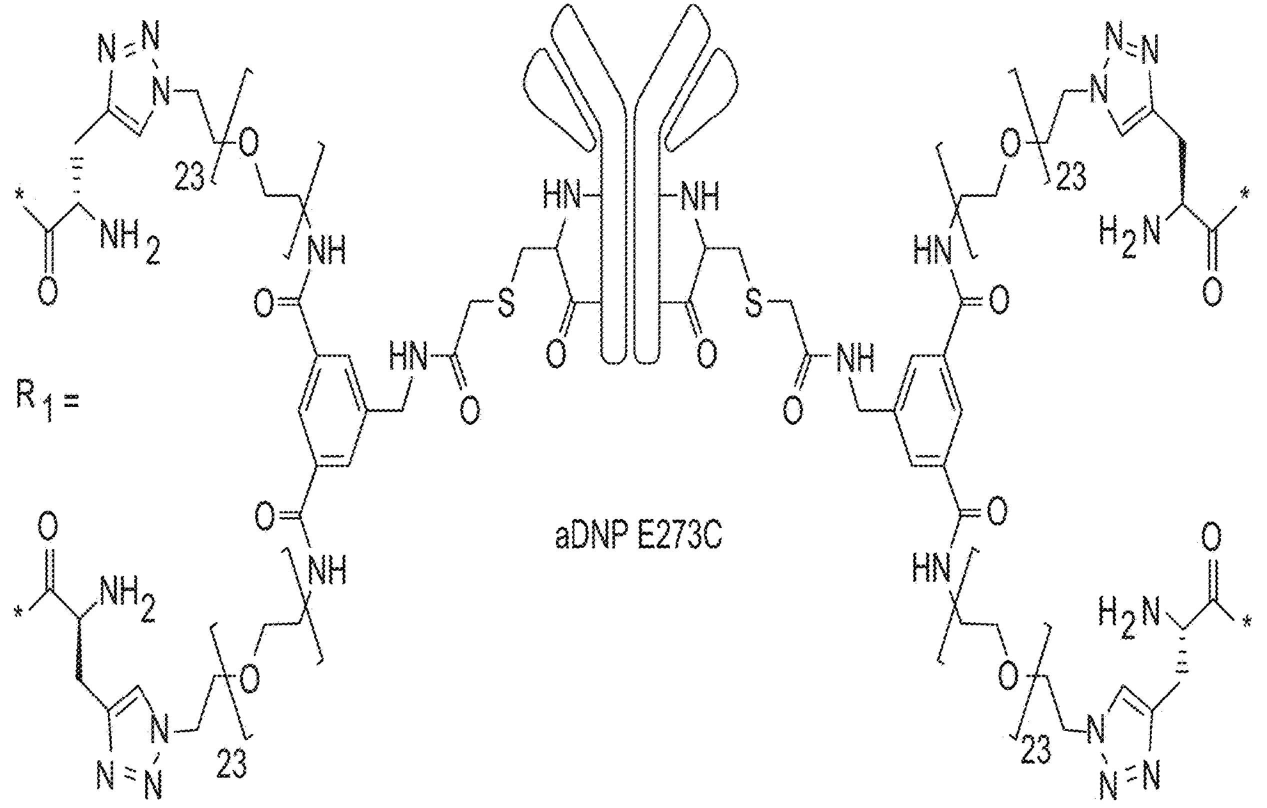
Figure 81C:
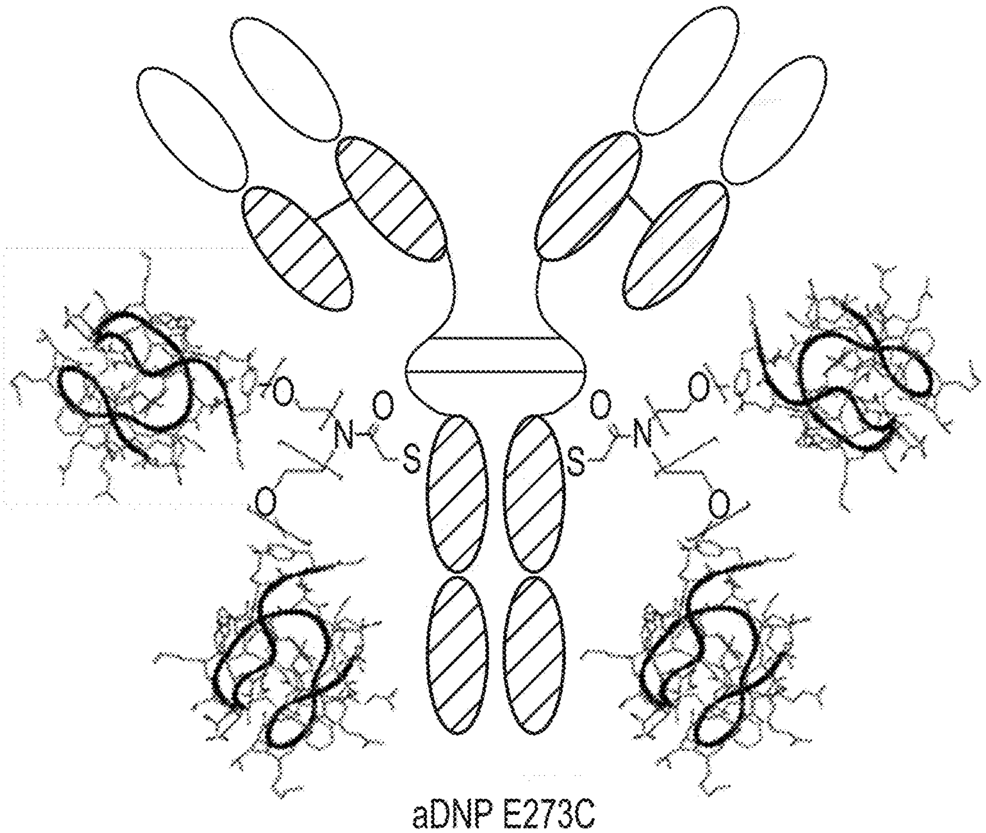
Figure 82:
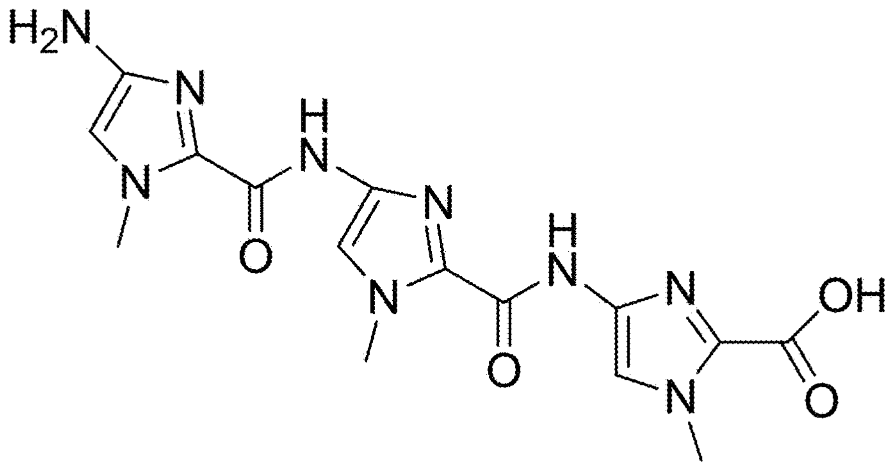
FIG. 82 shows the structure of an exemplary polyazole. (See, also, Sharma, S. K. et al., Org. Chem. 66, 1030-1034 (2001)).
Figure 84A:
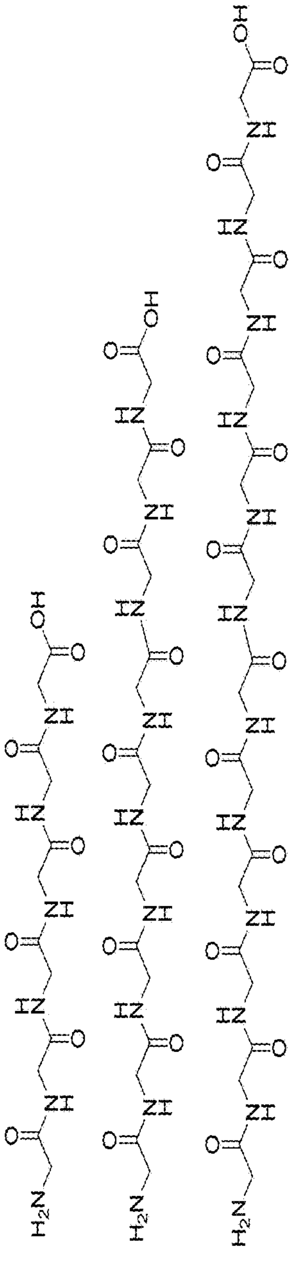
FIG. 84A-E shows chemical structures of exemplary peptidyl linkers (FIG. 84A-D), including helical and beta-hairpin scaffolds (FIG. 84E; KKYTYEINGKKITVEI//(SEQ ID NO:1745) and CHWEGNKLVC//(SEQ ID NO:1746).
Figure 84B:
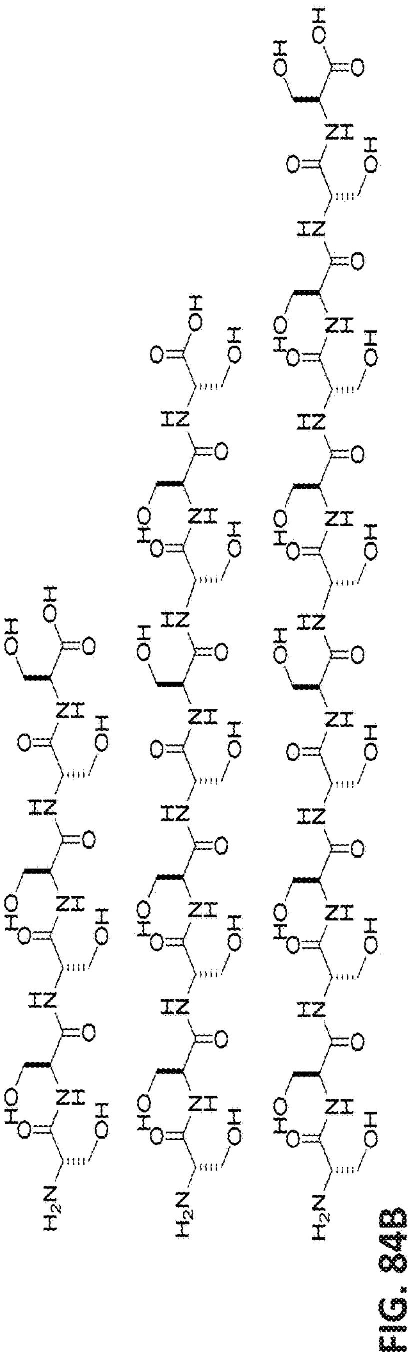
Figure 84C:
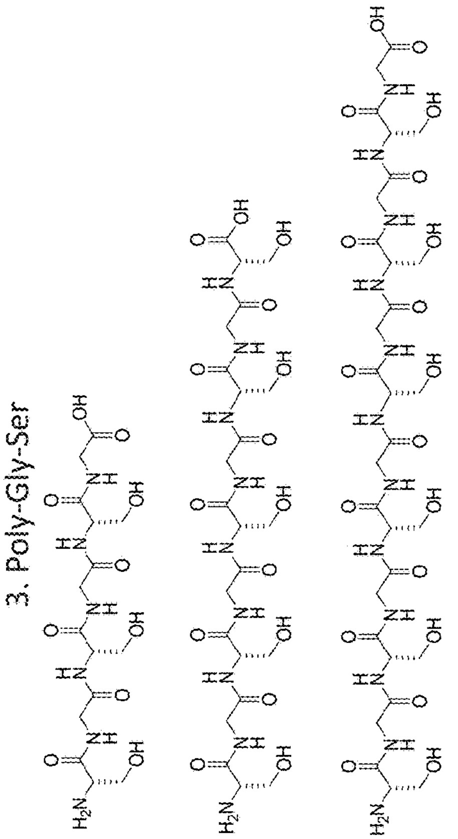
Figure 84D:
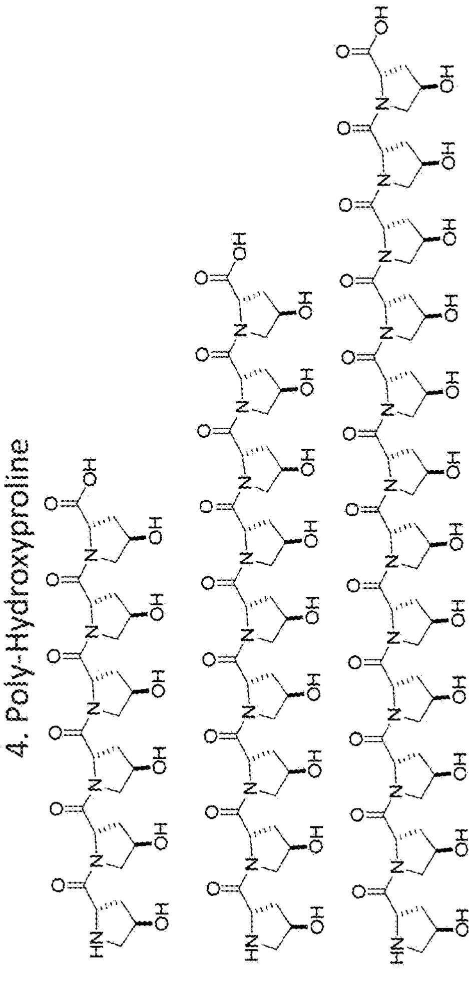
Figure 84E:
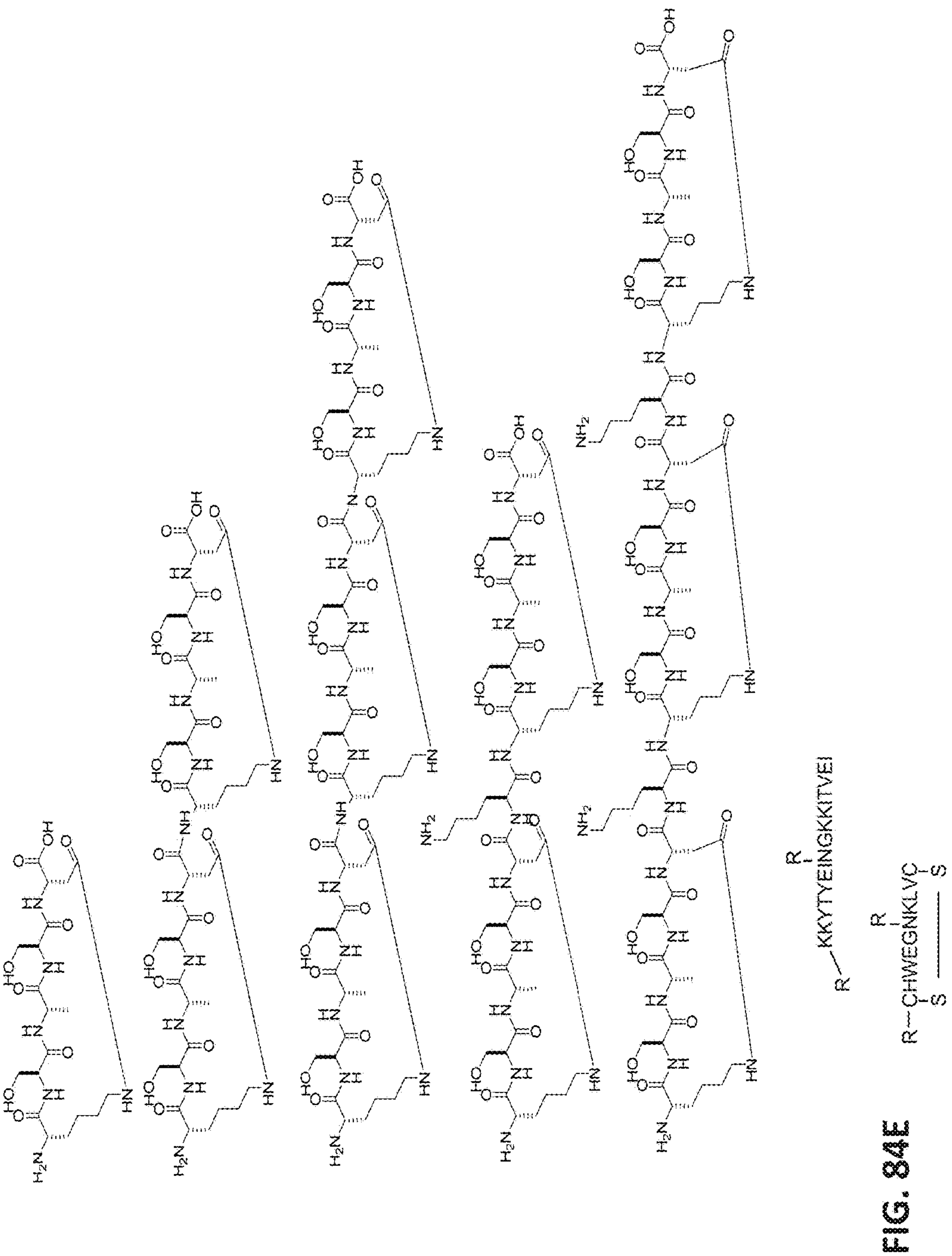

To identify sites within JzTx-V(1-29) (SEQ ID NO:2) that could be modified with a half-life extending moiety, a set of positional analogs was prepared containing norleucine at position 6 relative to SEQ ID NO:2 in place of the oxidizable methione and propargylglycine (Pra) at each non-cysteine position. This "Pra scan" was repeated with a [Nle6,Glu20] JzTx-V(1-29) scaffold. After folding, the alkyne-containing peptide was subjected to copper catalyzed 1,3-dipolar cycloaddition with a ~500 Da MW azido PEG to obtain the site-specifically PEGylated peptides with a triazole linkage, thus converting the propargylglycine or Pra residue in the sequence to a 3-(1,2,3-triazol-4-yl)alanine or Atz residue. (See FIG. 76A-B). Electrophysiological screening of this series of analogs (Table 9 and Table 13, above) identified several positions within JzTx-V, including the N-terminus and positions 1, 11, and 17 of SEQ ID NO:2, where a large chemical moiety could be introduced without significantly reducing potency at $Na_V1.7$. In general, these locations tend to be on the surface of JzTx-V, opposite or around the periphery of the hydrophobic face. Not all of the designed analogs in these series were successfully prepared via the high-throughput peptide synthesis approach. Additional positions were investigated and identified as potential conjugation sites, including positions 10, 12, 13, 14, and 20 relative to SEQ ID NO:2. Having identified these positions, peptide-linker constructs capable of conjugation to an engineered free cysteine residue within an IgG or Fc and homodimeric constructs of Atz-[Nle6]JzTx-V(1-29) (SEQ ID NO:571) were prepared (See, FIG. 81A) and tested (See, Table 9 and Table 13). Two of these homodimers, one with a reactive bromoacetamide functionality (see, Example 10). The bromoacetimide functionality was reacted with benzyl mercaptan to prevent deleterious reaction during assay analysis. Homodimeric conjugates were designated as follows (*=ethyl):

Bis-{Atz(PEG23*)-[Nle6]JzTx-V(1-29)}-5-((2-bromoacetamido)methyl)isophthalamide ("Homodimeric Conjugate No. 1") (See, FIG. 81A-2);

Bis-{Atz(PEG23*)-[Nle6]JzTx-V(1-29)}-5-((2-(benzylthio)acetamido)methyl)isophthalamide ("Homodimeric Conjugate No. 2") (See, FIG. 81A-2);

[Phe6,Atz(2 kDa EtO-PEG*-[Phe6,Atz13*]GpTx-1(1-34)1)13]GpTx-1(1-34) ("Homodimeric Conjugate No. 3") (See, FIG. 75A-B);

[Phe6,Atz(500 Da EtO-PEG*-[Phe6,Atz13*]GpTx-1(1-34)1)13]GpTx-1(1-34) ("Homodimeric Conjugate No. 4");

[Ala5,Phe6,Atz(2 kDa EtO-PEG*-{[Ala5,Phe6,Atz13*, Leu26,Arg28]GpTx-1(1-34)})13,Leu26,Arg28]GpTx-1(1-34) ("Homodimeric Conjugate No. 5").

Example 6: NMR Structure Determination of Pra-[Nle6]JzTx-V(1-29)

Figure 48:
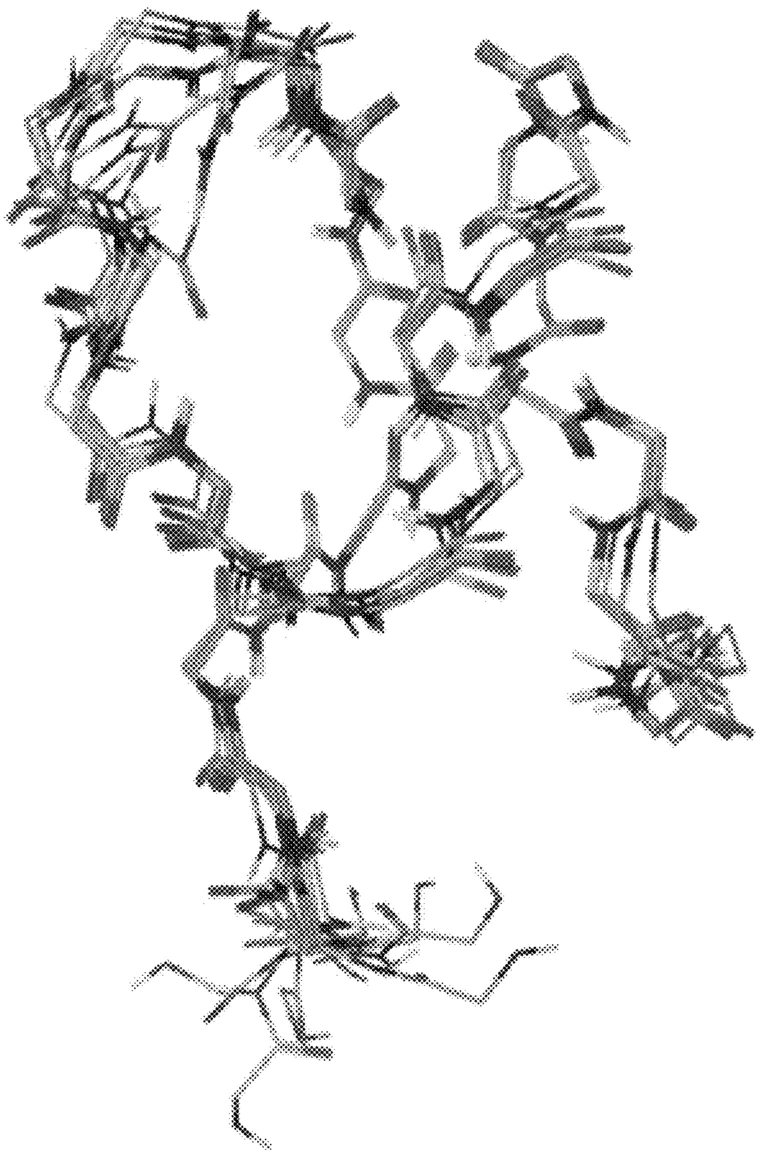
FIG. 48 shows an overlay of the 20 lowest energy conformations of the peptide backbone for the NMR solution structure of Pra-[Nle6]JzTx-V(1-29) (SEQ ID NO:425).
Figure 49:
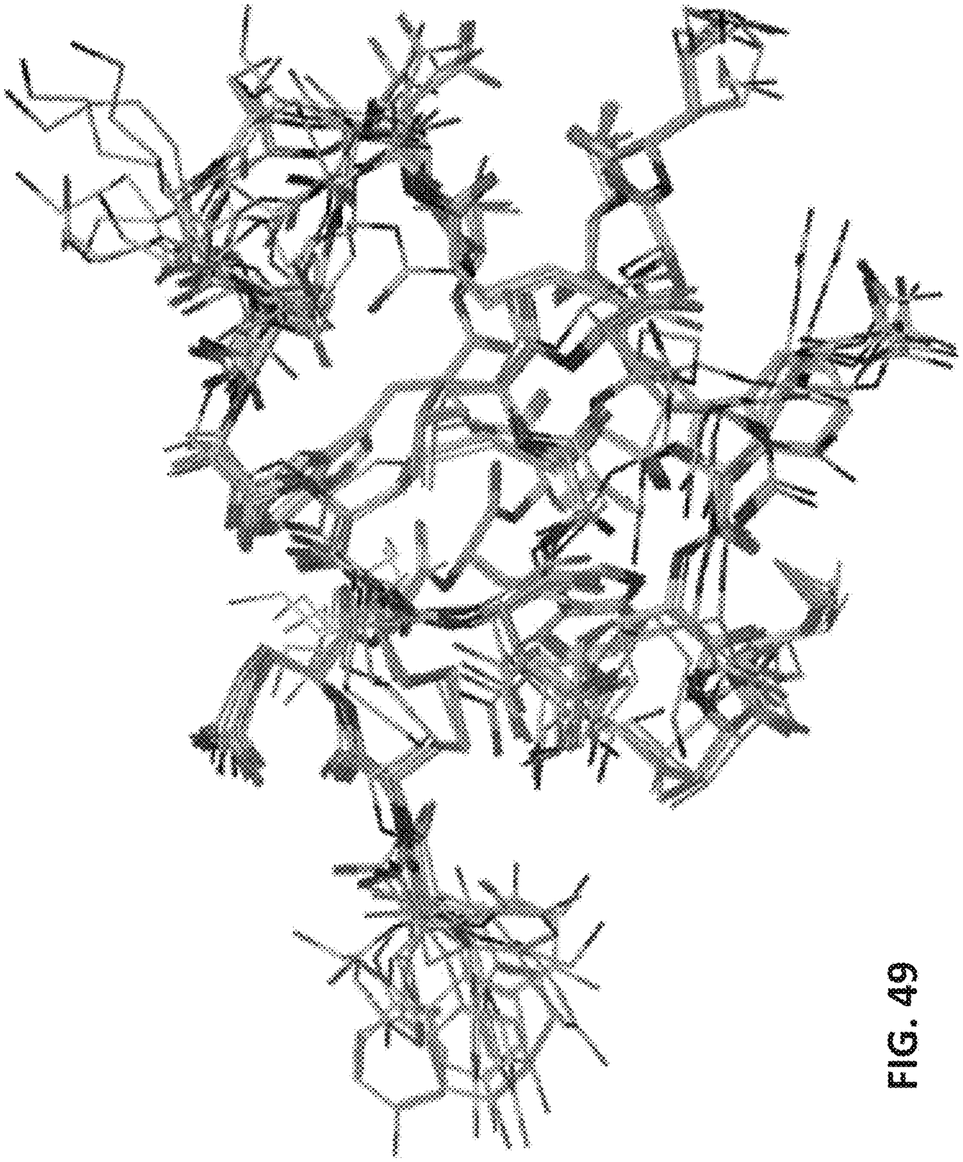
FIG. 49 shows an overlay of the heavy atoms from the 20 lowest energy conformations of the peptide for the NMR solution structure of Pra-[Nle6]JzTx-V(1-29) (SEQ ID NO:425).
Figure 50:
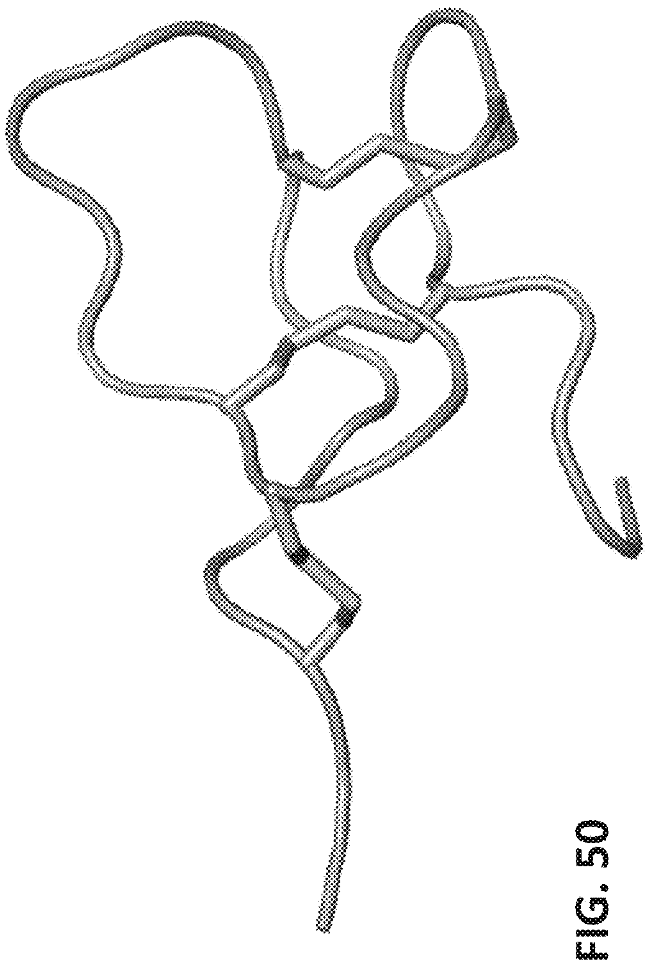
FIG. 50 shows a ribbon representation of the lowest energy conformation of the peptide backbone for the NMR solution structure of Pra-[Nle6]JzTx-V(1-29) (SEQ ID NO:425). The three disulfide bridges are represented as sticks.
Figure 51:
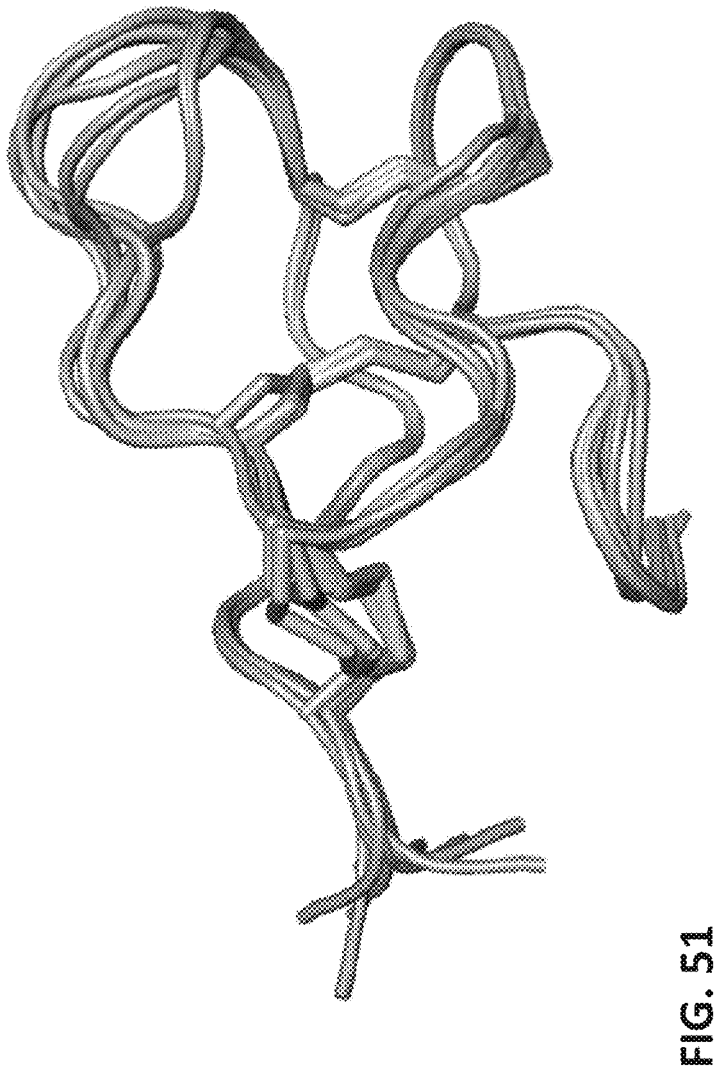
FIG. 51 shows an overlay of the ribbon representations of the 20 lowest energy conformation of the peptide backbone for the NMR solution structure of Pra-[Nle6]JzTx-V(1-29) (SEQ ID NO:425). The three disulfide bridges are represented as sticks.

The structure of Pra-[Nle6]JzTx-V(1-29)(SEQ ID NO:425) was obtained by high resolution NMR spectroscopy in water, pH 4.5 and T=320 K. The data were collected on a Bruker Avance III 800 MHz spectrometer using 2D NOESY, TOCSY, and HMBC experiments. (See Wutchrich, NMR of Proteins and Nucleic Acids, John Wiley & Sons, Canada, (1986)). The N-terminus of the peptide appeared to be disordered at this temperature, as resonances could not be identified for the three most N-terminal residues. The structure was calculated from 283 NOE constraints, 4 CHI1 angle constraints for cysteine side-chains derived from PADLOC (See Poppe L.; Hui J. O.; Ligutti, J.; Murray, J. K.; Schnier, P. D; PADLOC: a powerful tool to assign disulfide bond connectivities in peptide and proteins by NMR spectroscopy, Analytical Chemistry 84(1): 262-266 (2011)), and 3 disulfide-bond constraints, using Cyana 2.1 software. Glycine was modeled as a substitution for the N-terminal propargylglycine to simplify the structural calculations. The final RMSD for the backbone atoms of residues 5-30 was 0.45±0.07 Å (0.74±0.12 Å for all heavy atoms) and had no NOE or angle constraint violations. (See FIG. 48 for the overlay of the 20 lowest energy conformations of the peptide backbone, FIG. 49 for the overlay of the heavy atoms from the 20 lowest energy conformations of the peptide, FIG. 50 for a ribbon representation of the lowest energy conformation of the peptide backbone, and FIG. 51 for the overlay of the ribbon representations of the 20 lowest energy conformation of the peptide backbone). The structure confirms the disulfide connectivity of the six cysteine residues as $C_2$-$C_{16}$, $C_9$-$C_{21}$, and $C_{15}$-$C_{25}$ or a C1-C4, C2-C5, C3-C6 pattern, confirming that Pra-[Nle6]JzTx-V(1-29)(SEQ ID NO:425) is a member of the inhibitory cystine knot (ICK) family of peptides.

Figure 52:
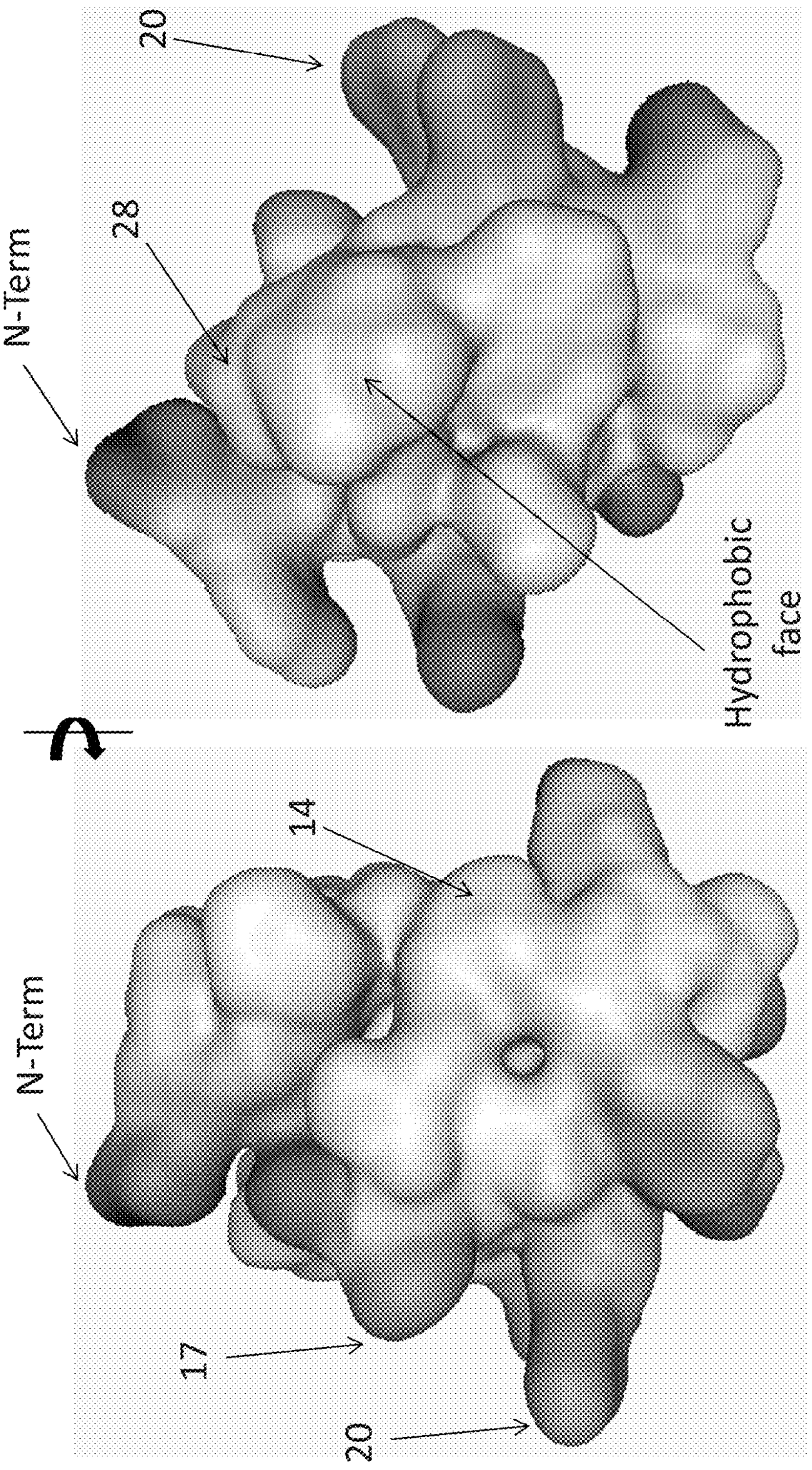
FIG. 52 shows a surface representation of the lowest energy conformation of the peptide for the NMR solution structure of Pra-[Nle6]JzTx-V(1-29) (SEQ ID NO:425). The image on the right is the hydrophobic face of the peptide, and the image on the left is the opposite face of the peptide (rotated 180° on the vertical axis).
Figure 53:
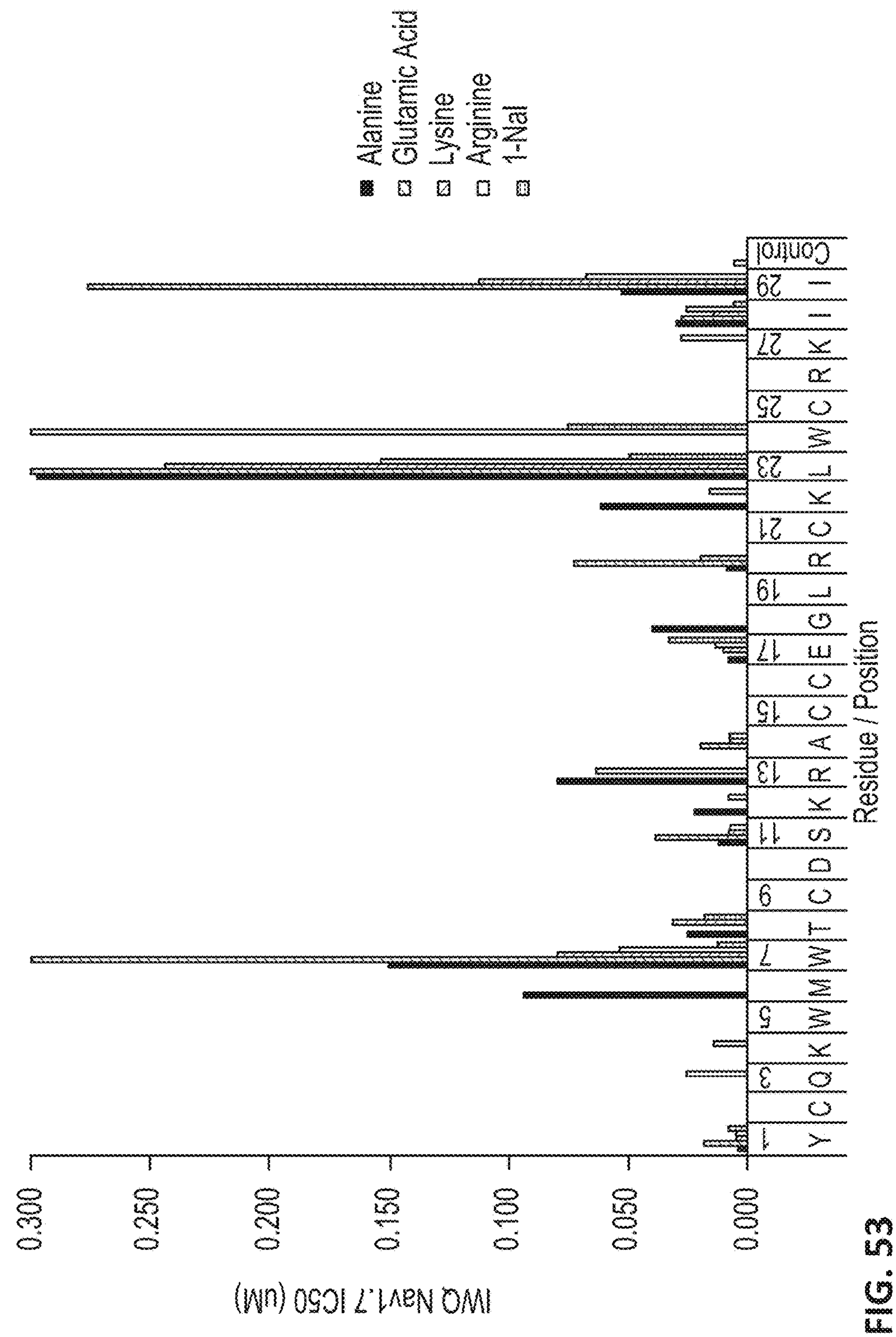
FIG. 53 shows the IWQ Nav1.7 IC50 of the single substitution analogs of JzTx-V. Note that substitution of Meth, Trp7, Leu23, Trp24, and Ile29 result in the largest relative losses in potency, indicating that these positions are important for interaction with the Nav1.7 channel.
Figure 54:
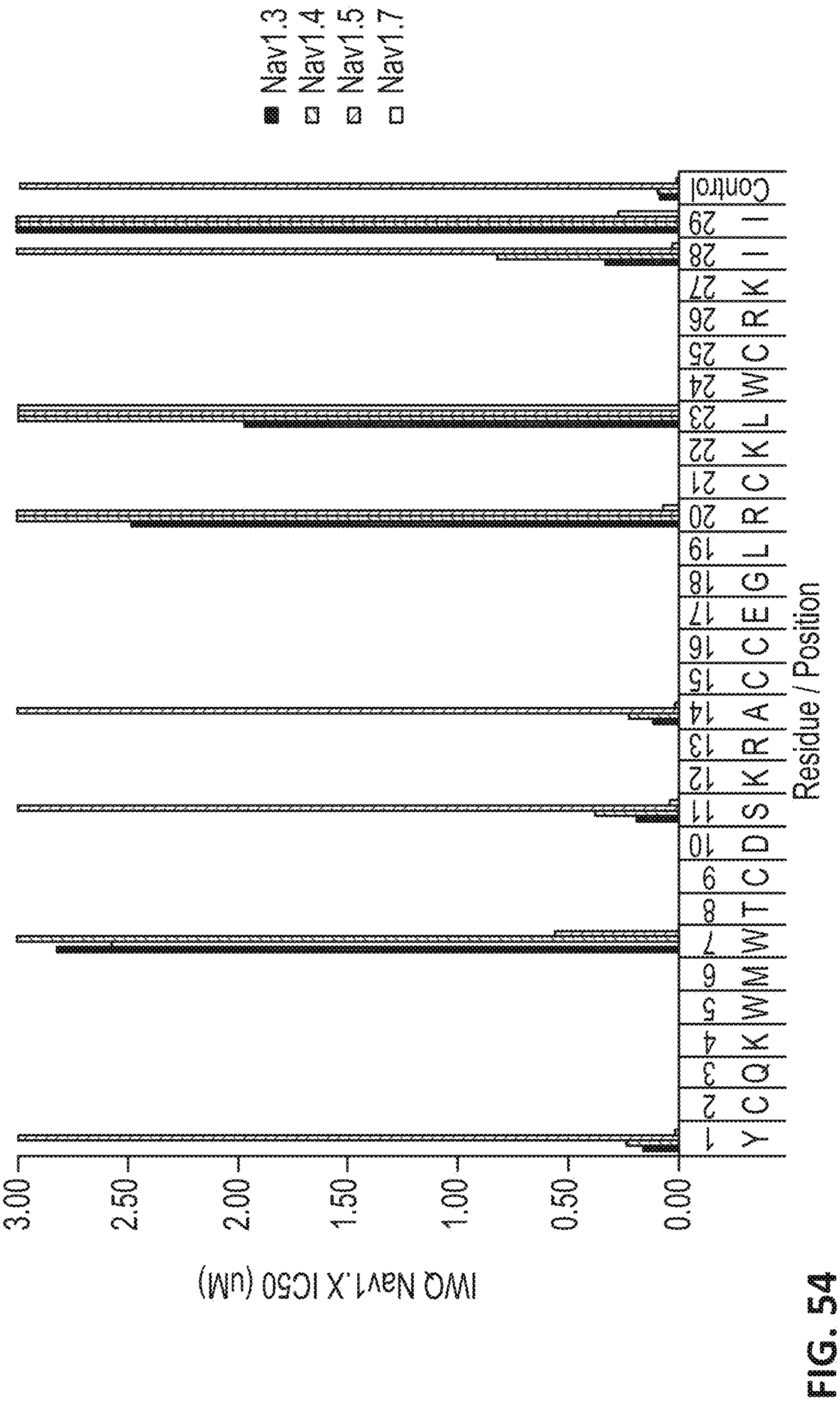
FIG. 54 shows the IWQ IC50 for each of the glutamic acid single substitution analogs against Nav1.7, Nav1.5, Nav1.4, and Nav1.3. Note that [Glu20]JzTx-V (SEQ ID NO:63) and [Glu28]JzTx-V (SEQ ID NO:69) had decreased activity relative to Nav1.7.

The folded structure of Pra-[Nle6]JzTx-V(1-29)(SEQ ID N):425) is amphipathic in nature with a hydrophobic face on one side of the molecule. (See, FIG. 52). The hydrophobic face is ringed by a number of hydrophilic (mostly cationic) residues. The opposite face of the folded peptide is more neutral in character. The systematic analoging of JzTx-V, in particular the positional scanning with alanine, arginine and glutamic acid, identifies several residues as being critical for activity at $Na_V1.7$. (See, FIG. 53). These residues, namely Trp5, Met6, Trp7, Leu23, Trp24, and Ile34, relative to SEQ ID NO:2, are clustered on the one face of JzTx-V. The hydrophobic side chains of residues Leu23, Trp24, and Ile34 of SEQ ID NO:425 align on one face of the C-terminal strand, while Trp5 and Met6 are adjacent to that strand to form the hydrophobic face. Trp7 further expands that hydrophobic face. Since changes that alter the nature of this face disrupt activity against $Na_V1.7$, this may be the portion of the molecule that interacts with the VGSCs at the binding interface. It was also observed that the N-terminus of the folded JzTx-V peptide was positioned the hydrophobic C-terminal residue Ile29 relative to SEQ ID NO:2. Although a glycine residue was used in the structure calculation, it was apparent that extending the N-terminus of the peptide with a hydrophobic residue, such as propargylglycine in Pra-[Nle6]JzTx-V(1-29) (SEQ ID NO:425), could position that residue in close proximity to the hydrophobic face of the molecule where it could contribute the binding interaction. This may help to explain the increased hNav1.7 potency of Pra-[Nle6]JzTx-V(1-29) (SEQ ID NO:425) and other N-terminally extended analogs. Substitution of a glutamic acid residue for either Arg20 or Ile28 resulted in increased selectivity against Nav1.4. (See Table 6, Table 11, and FIG. 54). Arg20 is quite distant from the hydrophobic face in the Pra-[Nle6]JzTx-V NMR structure. The guanadine of the Arg20 side chain is in close proximity to the carboxylic acid of Glu17, and these two functionalities may engage in a salt bridge that stabilizes the JzTx-V structure. Substitution of glutamic acid for arginine at position 20 would not only disrupt this possible salt bridge but create a repulsive electrostatic interaction that could alter the peptide conformation. It may be that the Glu20 substitution increases the Nav1.4 selectivity of JzTx-V more by influencing the conformation of the peptide than through a direct interaction with the channel. Conversely, Ile28 is located at the periphery of the hydrophobic face. Substitution of glutamic acid at position 28 also increases the Nav1.4 selectivity of JzTx-V, likely through a direct binding interaction with the channel. The NMR structure os Pra-[Nle6]JzTx-V shows that a number of the residues that can be modified without affecting potency and that have been explored as potential conjugation sites are on the face of the peptide opposite the hydrophobic face, i.e. positions 11, 14, and 17.

Example 7: Preliminary Pharmacokinetic Determinations in Rodents

Pharmacokinetic Studies.

A preliminary pharmacokinetic (PK) study was conducted with 7 week-old unmodified CD-1 mice from Taconic. [Glu20,Trp29]JzTx-V(1-29) (SEQ ID NO:112) was dosed to 6 mice at 1 mg/kg subcutaneously. Blood samples were taken at 0.5, 1, 1.5, 2, 3, and 4 hours post-dose from 3 mice at each time point. For each sample 15 μL of blood was collected via the carotid artery catheter and mixed in 35 μL of 0.1 M citrate buffer. Samples were then frozen at −80° C. until analysis.

LC-MS/MS Analytical Procedure.

Peptide stock solutions (1 mg/mL) were made from peptide reference standards in 50/50 (v/v) methanol/water and stored at −20° C. 1 mg/mL peptide stock solutions were used to prepare 100 μg/mL peptide working solution in 50/50 (v/v) methanol/water. The peptide working solutions were stored in a refrigerator at 2 to 8° C.

Standard samples were prepared in citrate-buffered mouse blood (blood/0.1M citrate buffer, 30/70, v/v). Standards concentrations of 5, 10, 25, 50, 100, 250, 500 and 1000 ng/mL were prepared by serial dilution of a freshly prepared 5000 ng/mL solution in citrate-buffered mouse blood using the 100 μg/mL peptide working solution. 25 μl blood samples were aliquoted into the appropriate well of a 96-well plate, followed by the addition of 50 μl of internal standard solution (100 ng/mL, peptide analog made in 50/50 methanol/water) and 150 μL of 0.1M $ZnSO_4$ and the samples were vortex mixed for 5 min, then centrifuge for 10 min at 4000 rpm. Supernatant was then extracted using an Oasis HLB μElution 96-well solid phase extraction plate to extract peptides and the extracts were injected (10 μL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH $C_{18}$ 2.1 mm×50 mm column. The mobile phases were 0.1% formic acid in acetonitrile/water (5/95, v/v, mobile phase A) and 0.1% formic acid in acetonitrile/water (95/5, v/v, mobile phase B). Data was collected and processed using AB Sciex Analyst® software (version 1.5).

The calibration curve was derived from the peak area ratios (peptide/internal standard) using $1/x^2$ weighted linear least-squares regression of the area ratio versus the concentration of the corresponding peptide standard. The regression equation from the calibration standards was used to back calculate the measured concentration for each standard and blood samples.

Figure 55:
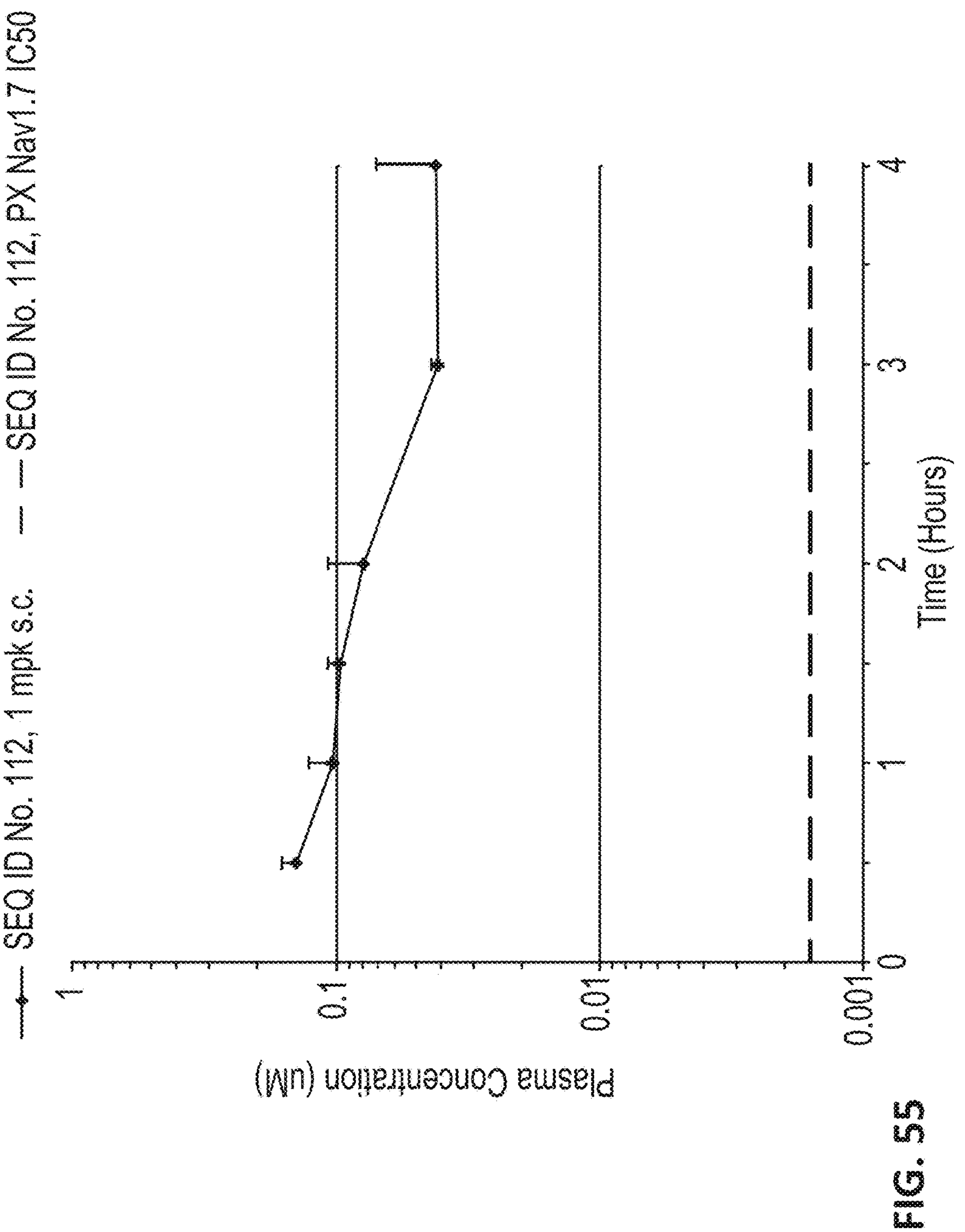
FIG. 55 shows the pharmacokinetic time course of plasma concentrations of [Glu20,Trp29]JzTx-V(1-29) (SEQ ID NO:112) following a 1 mg/kg s.c. dose in male CD-1 mice in relation to the hNav1.7 PX IC50.

Results. In the pharmacokinetic study a 1 mg/kg subcutaneous (s.c.) dose of [Glu20,Trp29]JzTx-V(1-29)(SEQ ID NO:112) to mice was tolerated and showed measureable plasma concentrations for 4 h with an approximate in vivo half-life of 2.08 h. The dose yielded peptide concentrations in the plasma that were sustained at about 0.04 μM, 26-fold over the in vitro hNav1.7 $IC_{50}$ as measured by PATCHXPRESS® (PX) patch clamp system, for 3 h, which was deemed suitable for further in vivo testing. (See, FIG. 55).

Additional Mouse Pharmacokinetic Studies.

A preliminary pharmacokinetic (PK) study was conducted for CyA-[Nle6,Pra17,Glu28]JzTx-V(1-29) (SEQ ID NO:395) and Pra-[Nle6,Glu28]JzTx-V(1-29) (SEQ ID NO:328) with 10 week-old CD-1 mice from Charles River Laboratories. Each test compound was dosed to 6 mice at 2 or 5 mg/kg by subcutaneous administration under the skin on the back. Blood samples were taken at various time points using composite sampling scheme. For each sample 50 μL of blood was collected via submandibular vein puncture and then transferred into a blood collection tube containing $K_2EDTA$ as an anticoagulant. Samples were processed for plasma and transferred to a 96-well plate then frozen at −80° C. until analysis.

A preliminary pharmacokinetic (PK) study was conducted with 10 week-old female Sprague-Dawley rats from Charles River Laboratories. CyA-[Nle6,Pra17,Glu28]JzTx-V(1-29) (SEQ ID NO:395) was dosed to 6 rats (2 per dose) at 1, 3 or 10 mg/kg subcutaneously under the skin over the shoulders. Blood samples were taken at 1, 3 and 5 hours by tail vein nick and at 24 hours by abdominal aorta while the rats were under isofurane anesthesia. For each sample 200 μL of blood was collected and dispensed into a blood collection tube containing $K_2EDTA$ as an anticoagulant. Samples were processed for plasma and transferred to a 96-well plate then frozen at −80° C. until analysis.

LCMS Analytical Method for the Peptides.

Standard samples were prepared in mouse or rat plasma. Standards concentrations of 0.3, 0.6, 1.2, 2.4, 4.8, 9.6, 20, 40, 80, 156, 312, 625, 1250, 2500, 5000 ng/mL were prepared by serial dilution of a freshly prepared 10000 ng/mL solution in mouse or rat plasma using the 100 μg/mL peptide working solution. 50 μl plasma samples were aliquoted into the appropriate well of a 96-well plate, followed by the addition of 50 μl of internal standard solution (100 ng/mL, peptide analog made in 50/50 methanol/water) and 100 μL of 8M guanidine HCl solution and the samples were vortex mixed for 5 min, then extracted using an Oasis HLB μElution 96-well solid phase extraction plate to extract peptides and the extracts were injected (10 μL) onto the LC-MS/MS system for analysis.

The LC-MS/MS consisted of a Shimadzu LC-AD20 system (Shimadzu, Columbia, Md.) coupled to a 4000 QTRAP mass spectrometer (AB Sciex, Toronto, Canada) with a Turbo IonSpray® ionization source. The analytical column was an ACE Phenyl 5, 2.1 mm×50 mm column. The mobile phases were 0.1% formic acid in acetonitrile/water (mobile phase A) and 0.1% formic acid in acetonitrile/water (mobile phase B). Data was collected and processed using AB Sciex Analyst® software (version 1.6).

The calibration curve was derived from the peak area ratios (peptide/internal standard) using $1/x^2$ weighted linear least-squares regression of the area ratio versus the concentration of the corresponding peptide standard. The regression equation from the calibration standards was used to back calculate the measured concentration for each standard and plasma samples.

Mouse Pharmacokinetic Studies for the Immunoglobulin-Peptide Conjugates.

A preliminary pharmacokinetic (PK) study was conducted with 10 week-old CD-1 mice from Charles River Laboratories. Each tested conjugate was dosed to 6 to 9 mice at 5 mg/kg intravenously via the lateral tail vein or subcutaneously under the skin over the shoulders. Blood samples were taken at various time points using composite sampling scheme with no more than 3 samples taken from an individual mouse. For each sample 60 μL of blood was collected via submandibular and retro orbital sinus vein puncture and dispensed into a serum separator tube. Samples were allowed to clot at room temperature for 20 minutes and then centrifuged under refrigerated conditions (2-8° C.) for 15 minutes at approximately 11500×g. Serum was transferred to a 96-well plate and frozen at −80° C. until analysis.

LC-MS/MS Analytical Procedure for the Peptide Conjugates.

Peptide conjugate stock solutions (1 mg/mL) were made from peptide conjugate reference standards in A5Su buffer and stored at −70° C. 1 mg/mL peptide conjugate stock solutions were used to prepare 100 μg/mL conjugate working solution in A5Su buffer. The conjugate working solutions were stored in a refrigerator at 2 to 8° C.

Standard samples were prepared in mouse serum. Standards concentrations of 50, 100, 250, 500, 1000, 2500, 5000 and 10,000 ng/mL were prepared by serial dilution of a freshly prepared 10,000 ng/mL solution in mouse serum using the 100 μg/mL peptide conjugate working solution. 25 μl mouse serum samples were aliquoted into the appropriate well of a 96-well plate, followed by the addition of 25 μl of DPBS (2× inhibitor) and 25 uL of magnetic beads with anti-human Fc immunoaffinity capture antibody. Samples were then incubated for 60 min at room temperature. After washing with 250 mM Tris buffer, the beads with captured peptide conjugate analyte were reduced by tris(2-carboxyethyl) phosphine (TCEP) and digested by trypsin. After quenched with 1% formic acid, samples were centrifuged and the supernatant was transferred to a 96-well plate then injected (10 μL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH C18 column (2.1 mm×50 mm) The mobile phases were 0.1% formic acid in acetonitrile/water (5/95, v/v, mobile phase A) and 0.1% formic acid in acetonitrile/water (95/5, v/v, mobile phase B). Data was collected and processed using AB Sciex Analyst® software (version 1.5).

The calibration curve was derived from the peak area ratios (peptide/internal standard) using $1/x^2$ weighted linear least-squares regression of the area ratio versus the concentration of the corresponding peptide standard. The regression equation from the calibration standards was used to back calculate the measured concentration for each standard and blood samples.

Example 8: In Vivo Pain Models

The compositions of the present invention can be tested in any relevant in vivo pain models. Examples include:

Tactile Allodynia—Von Frey Test.

Von Frey filaments are used to assess mechanical sensitivity in rodents. Mice are placed on a wire mesh floor, enclosed in an individual testing chamber and allowed to acclimate until calm. Calibrated filaments of various bending forces are then applied to the paw of a mouse to measure the response to a non-noxious tactile (e.g., touch) stimulus. The pattern of responses and non-responses to the series of filaments determines the animal's mechanical threshold. This threshold is used as the endpoint of the assay.

Rat Neuropathic Pain Model.

Male Sprague-Dawley rats (200 g) are anesthetized with isoflurane inhalant anesthesia and the left lumbar spinal nerves at the level of L5 and L6 are tightly ligated (4-0 silk suture) distal to the dorsal root ganglion and prior to entrance into the sciatic nerve, as first described by Kim and Chung (An experimental model for peripheral neuropathy produced by segmental spinal nerve ligation in the rat. Pain 50:355-363, (1992)). The incisions are closed and the rats are allowed to recover. This procedure results in mechanical (tactile) allodynia in the left hind paw as assessed by recording the pressure at which the affected paw (ipsilateral to the site of nerve injury) is withdrawn from graded stimuli (von Frey filaments ranging from 4.0 to 148.1 mN) applied perpendicularly to the plantar surface of the paw (between the footpads) through wire-mesh observation cages. A paw withdrawal threshold (PWT) is determined by sequentially increasing and decreasing the stimulus strength and analyzing withdrawal data using a Dixon non-parametric test, as described by Chaplan, S. R., et al. (Quantitative assessment of tactile allodynia in the rat paw. J. Neurosci. Meth, 53:55-63 (1994)).

Rat CFA Inflammatory Pain Model.

Male Sprague-Dawley rats (200 g) are injected in the left hindpaw with complete Freund's adjuvant (CFA). This procedure results in mechanical (tactile) and thermal allodynia in the left hind paw as assessed by recording the pressure at which the affected paw is withdrawn from graded stimuli (von Frey filaments ranging from 4.0 to 148.1 mN) applied perpendicularly to the plantar surface of the paw (between the footpads) through wire-mesh observation cages or by applying radiant heat. PWT is determined by sequentially increasing and decreasing the stimulus strength and analyzing withdrawal data using a Dixon non-parametric test, as described by Chaplan et al. (1994). Rats are included in the study only if they do not exhibit motor dysfunction (e.g., paw dragging or dropping) or broken skin and their PWT is below 39.2 mN (equivalent to 4.0 g). At appropriate times after CFA injection rats are treated with test peptides and/or test vehicle-conjugated peptides (usually a screening dose of 60 mg/kg) or control solution (PBS or other vehicle) once by s.c. injection and PWT is determined Average paw withdrawal threshold (PWT) was converted to percent of maximum possible effect (% MPE) using the following formula: % MPE=100*(PWT of treated rats−PWT of control rats)/(15-PWT of control rats). Thus, the cutoff value of 15 g (148.1 mN for mechanical allodynia) is equivalent to 100% of the MPE and the control response is equivalent to 0% MPE.

Preferred molecules of the present invention are expected to produce an antinociceptive effect with a PD with appropriate exposures compared to $IC_{50}$ on the target.

Mouse Formalin Pain Model Experimental Procedure.

Formalin injection into a rodent paw evokes a well-studied form of pain quantitated by the number of times the animal flinches its paw. The pain following formalin injection comes in two characteristic phases: a first phase lasts approximately ten minutes and likely corresponds to the immediate pain mediated by peripheral neurons. The second phase, beginning approximately ten minutes after formalin injection and lasting for another 30 to 40 minutes, corresponds to sensitization of neurons in the spinal cord and hyperactivity of peripheral pain-sensing neurons. Compounds represented in this application were tested to see if they reduce the number of flinches in phase II of the formalin response and so are potential analgesic drugs (Bregman H et al., "Identification of a potent, state-dependent inhibitor of Nav1.7 with oral efficacy in the formalin model of persistent pain." J Med Chem 54(13):4427-4445, 2011).

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020X) and water and were maintained on a 12-h light/dark cycle for the entire duration of the study. All animals were housed on standard solid-bottomed caging with corn cob bedding with 1 animal per cage. The animal colony was maintained at approximately 21° C. and 60% humidity. All experiments were conducted in accordance with the International Association for the Study of Pain guidelines.

On test day, during or before acclimation, the animals were dosed with either an investigational compound or vehicle. Following dose administration, all mice (n=12) were conditioned to behavioral analysis chambers (dimensions: 10 cm diameter, 14 cm tall cylinder with lid on top of elevated glass) for 5 minutes prior to the formalin injection. Video cameras were set underneath for recording the mouse behavior (5 minute acclimation and 40 minute test session). At test time, mice were lightly restrained in a cloth glove and injected with 20 μL of a 2% formalin solution into the dorsal surface of the left hind paw using an insulin syringe (U100, 0.3 cc, 28-30G) Immediately following the formalin injection, animals were returned to the chamber and observed for 40 minutes. Paw lifting/licking behavior was recorded in 5 minute intervals after which ipsilateral and contralateral paw widths were measured. After study completion animals were immediately euthanized.

Figure 56:
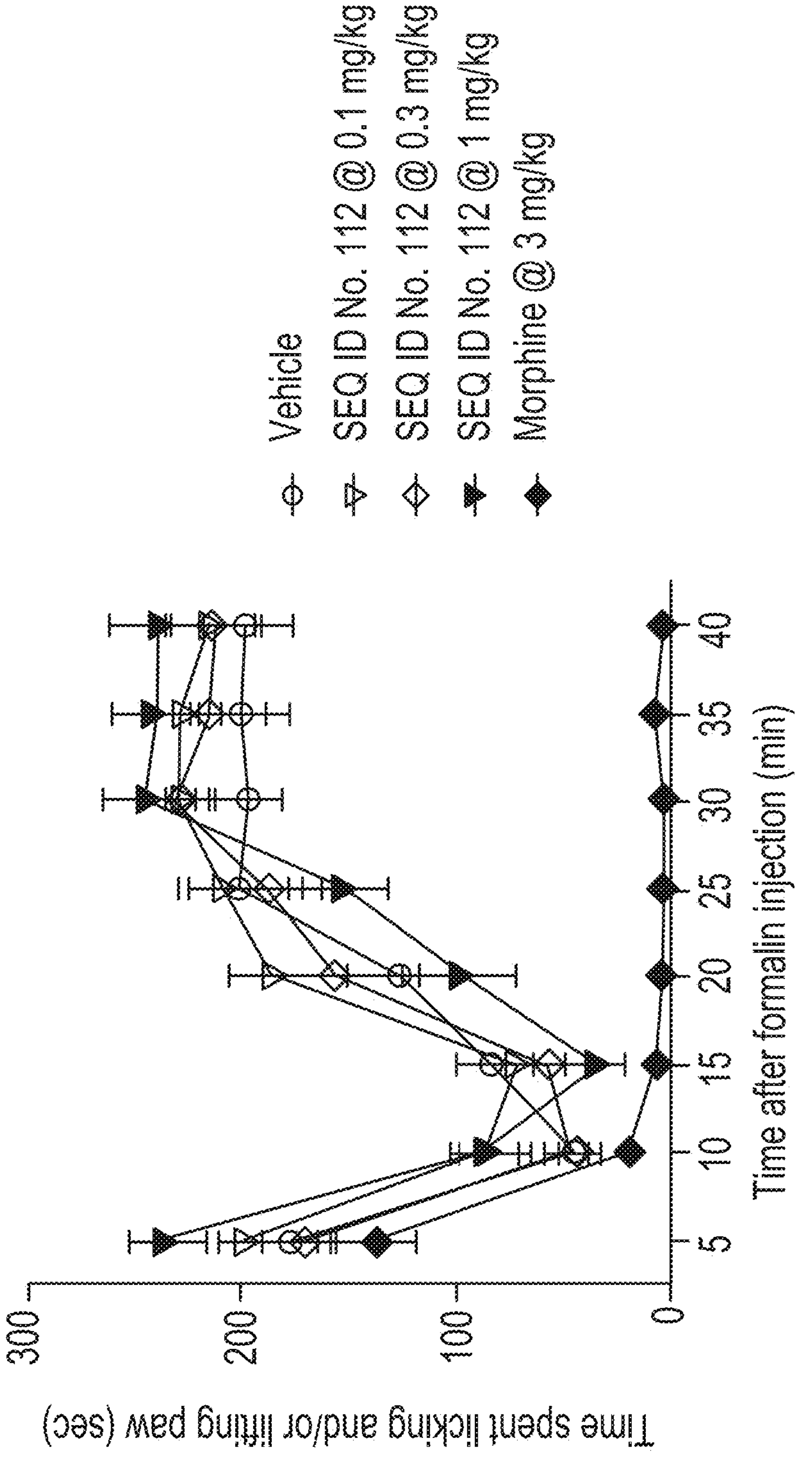
FIG. 56 shows the timecourse of the effect of [Glu20, Trp29]JzTx-V(1-29) (SEQ ID NO:112) in the formalin pain model in male CD-1 mice with a 1-hour pre-treatment dose of 0.1, 0.3, or 1.0 mg/kg s.c. The peptide had no effect in the first or acute phase (0-5 minutes post-formalin injection). The peptide had no effect on the time spent lifting and/or licking the affected paw during the second phase (5-40 minutes post-formalin injection, associated with spinal sensitization) compared to vehicle (PBS). The positive control, a 3 mg/kg s.c. dose of morphine was sufficient to significantly reduce pain response in the animals. The terminal plasma exposures (peptide plasma concentrations at 45 min post-formalin injection) for the peptide were 0.0278±0.0105, 0.121±0.0411, and 0.412±0.0858 μM for the 0.1, 0.3, or 1.0 mg/kg doses, respectively. Data Represent Mean±SEM; Outliers Removed (n=12).
Figure 57:
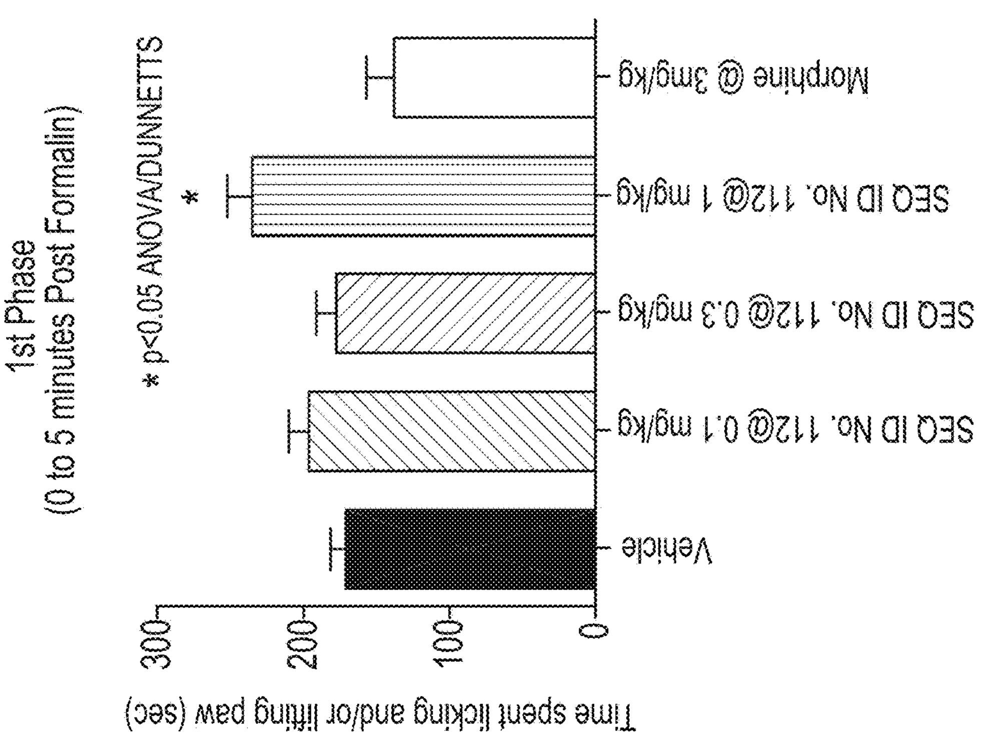
FIG. 57 shows the effect of [Glu20,Trp29]JzTx-V(1-29) (SEQ ID NO:112) in the formalin pain model in male CD-1 mice with a 1-hour pre-treatment dose of 0.1, 0.3, or 1.0 mg/kg s.c. during the first phase (0-5 minutes post formalin injection). Neither the peptide nor the morphine positive control significantly reduced the time spent lifting and/or licking the affected paw during the first phase. It was observed that the 1 mg/kg dose of peptide may have slightly increased the pain response relative to the vehicle (phosphate buffered saline [PBS]). Pharmacological reductions in flinching during this first phase generally reflect nonspecific effects on animal movement, consciousness, or health rather than an actual reduction in pain. Data Represent Mean±SEM; *$p<0.05$ by ANOVA/DUNNETTS; Outliers Removed (n=12).
Figure 58:
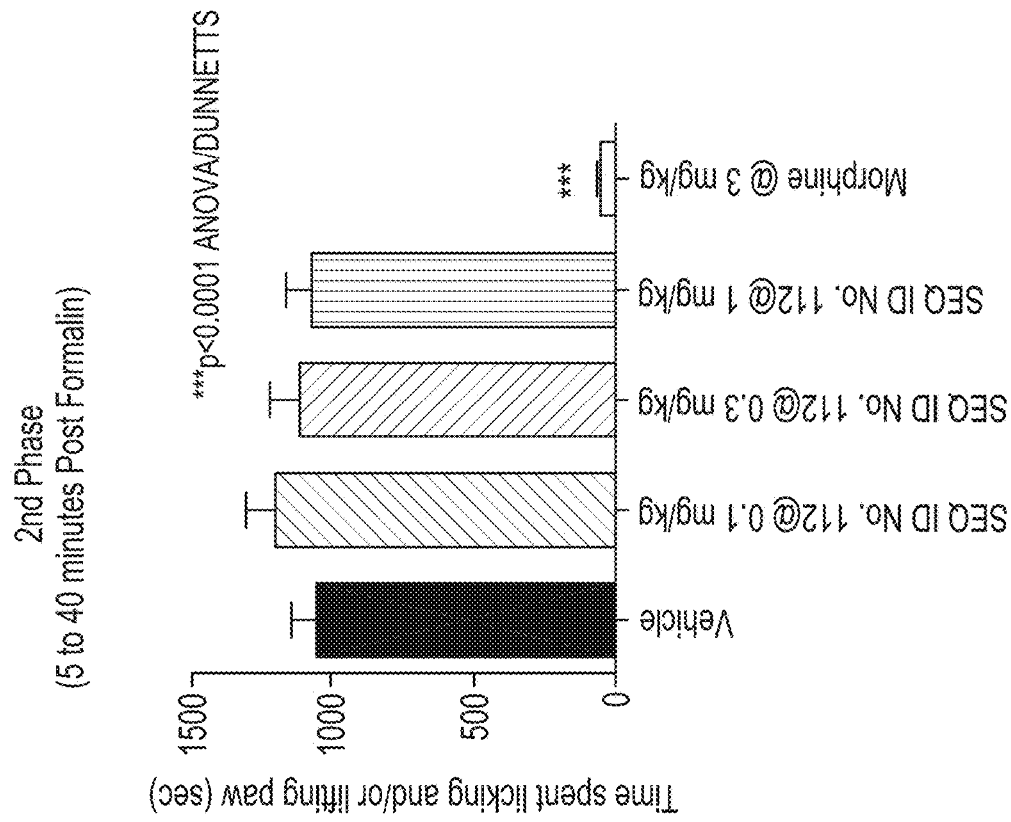
FIG. 58 shows the effect of [Glu20,Trp29]JzTx-V(1-29) (SEQ ID NO:112) in the formalin pain model in male CD-1 mice with a 1-hour pre-treatment dose of 0.1, 0.3, or 1.0 mg/kg s.c. during the second phase (5-40 minutes post formalin injection). The morphine control but not the peptide significantly reduced the time spent lifting and/or licking the affected paw during the second phase. Data Represent Mean±SEM; ***$p<0.0001$ by ANOVA/DUNNETTS; Outliers Removed (n=12).

In the first mouse formalin pain model study, [Glu20, Trp29]JzTx-V(1-29) (SEQ ID NO:112) was dosed at 0.1, 0.3, and 1.0 mg/kg s.c. 1-hour pre-treatment with morphine at 3 mg/kg s.c. 30-min pre-treatment as the positive control. (See, FIG. 56). The peptide had no effect on time spent lifting and/or licking the affected paw in either the first or acute phase (0-5 minutes post-formalin injection) or during the second phase (5-40 minutes post-formalin injection) compared to vehicle (PBS). (See, FIG. 57 and FIG. 58). In this experiment the 3 mg/kg s.c. dose of morphine used as a positive control significantly reduced the pain response in the animals. The terminal plasma exposure (peptide plasma concentrations at 45 min post-formalin injection) for the peptide was 0.0278±0.0105, 0.121±0.0411, and 0.412±0.0858 μM for the 0.1, 0.3, or 1.0 mg/kg doses, respectively.

Figure 59:
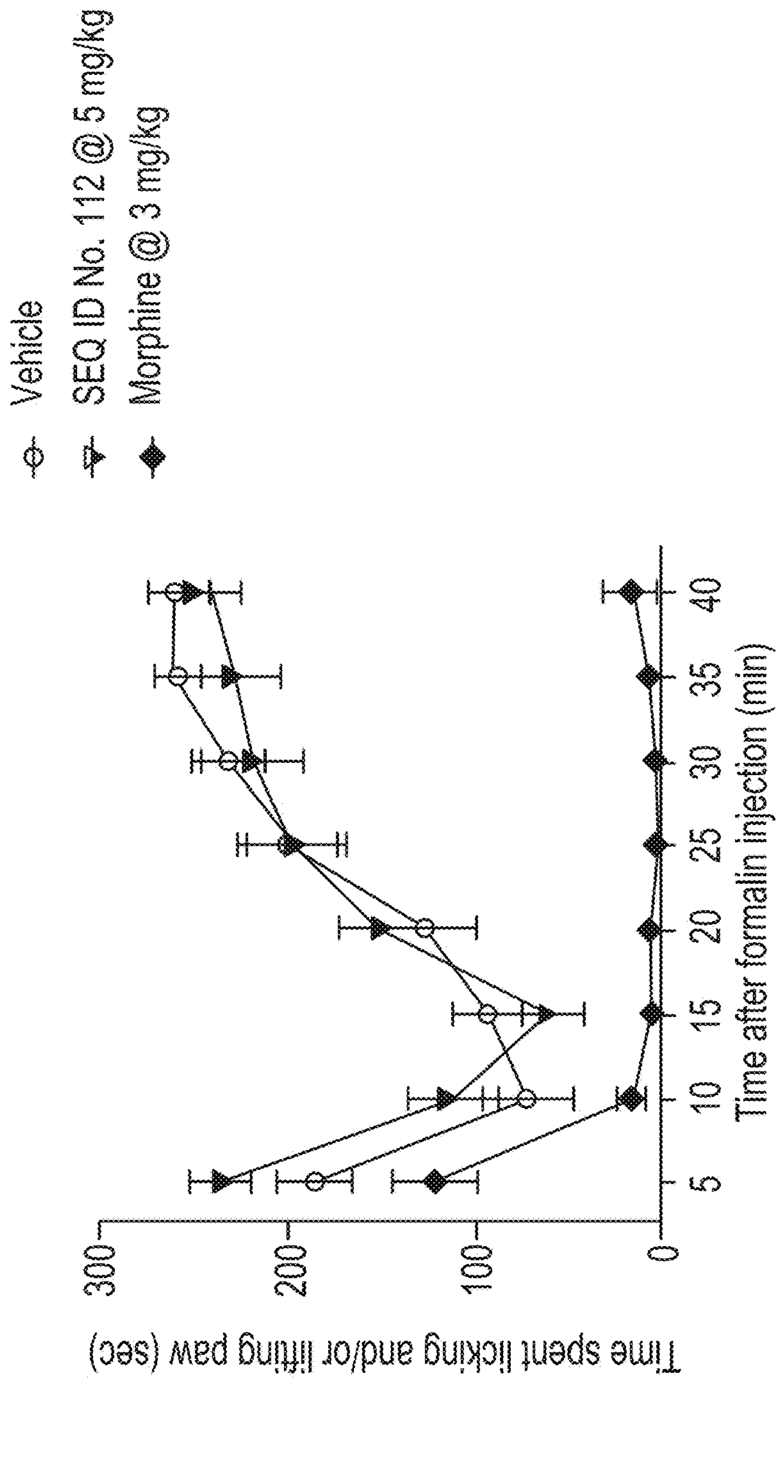
FIG. 59 shows the timecourse of the effect of [Glu20, Trp29]JzTx-V(1-29) (SEQ ID NO:112) in the formalin pain model in male CD-1 mice with a 1-hour pre-treatment dose of 5.0 mg/kg s.c. After a lack of efficacy was observed at peptide doses <1 mg/kg, the formalin pain model was repeated with an increased peptide dose of 5.0 mg/kg s.c. The peptide had no effect in the first or acute phase (0-5 minutes post formalin injection). The peptide had no effect on the time spent lifting and/or licking the affected paw during the second phase (5-40 minutes post formalin injection, associated with spinal sensitization) compared to vehicle (PBS). The positive control, a 3 mg/kg s.c. dose of morphine was sufficient to significantly reduce pain response in the animals. The terminal plasma exposure (peptide plasma concentrations at 45 min post formalin injection) for the peptide was 2.63±0.777 μM. Data Represent Mean±SEM; Outliers Removed (n=12).
Figure 60:
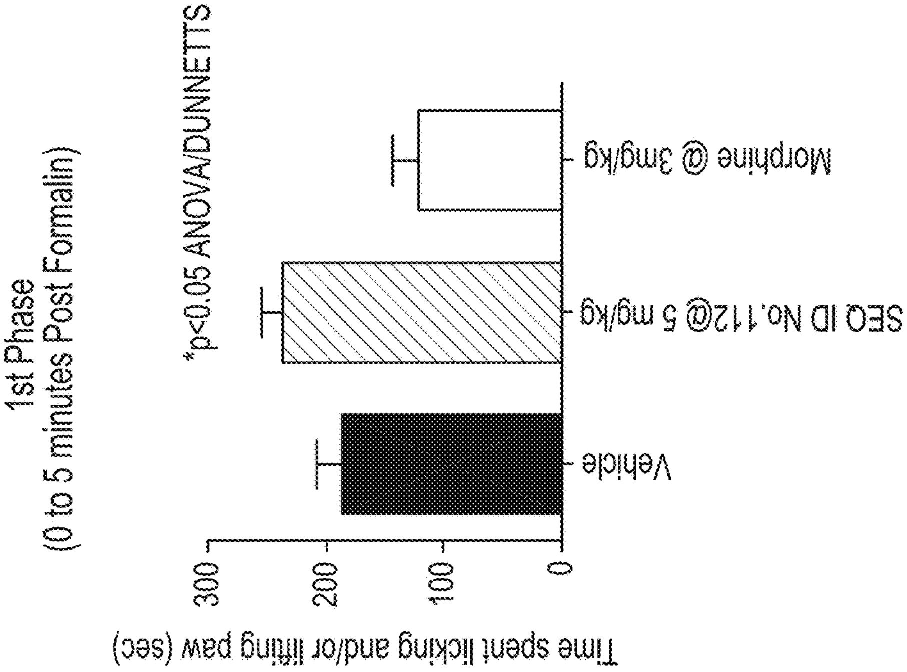
FIG. 60 shows the effect of [Glu20,Trp29]JzTx-V(1-29) (SEQ ID NO:112) in the formalin pain model in male CD-1 mice with a 1-hour pre-treatment dose of 5.0 mg/kg s.c. (n=8) during the first phase (0-5 minutes post formalin injection). Neither the peptide nor the morphine positive control (s.c., 3 mg/kg, 30' preTx, n=8) significantly reduced the time spent lifting and/or licking the affected paw during the first phase. Data Represent Mean±SEM; ***$p<0.05$ by ANOVA/DUNNETTS; Outliers Removed (n=12).
Figure 61:
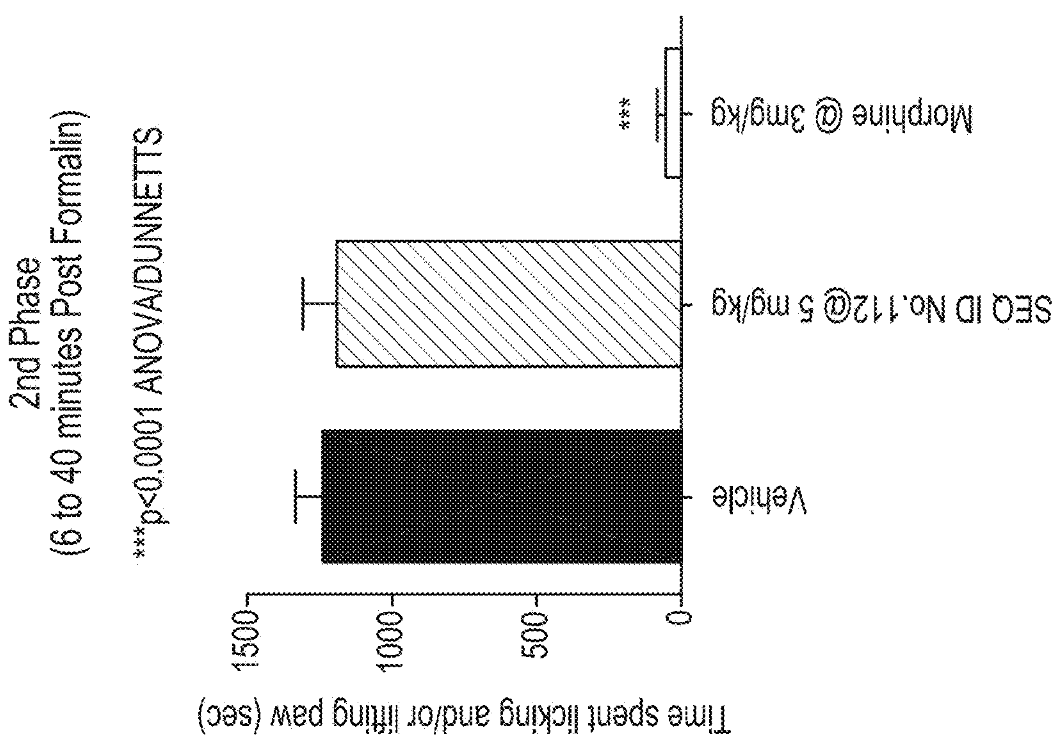
FIG. 61 shows the effect of [Glu20,Trp29]JzTx-V(1-29) (SEQ ID NO:112) in the formalin pain model in male CD-1 mice with a 1-hour pre-treatment dose of 5.0 mg/kg s.c. (n=8) during the second phase (5-40 minutes post formalin injection). The morphine control (s.c., 3 mg/kg, 30' preTx, n=8) but not the peptide significantly reduced the time spent lifting and/or licking the affected paw during the second phase. Data Represent Mean±SEM; ***p<0.0001 by ANOVA/DUNNETTS; Outliers Removed (n=12).

The mouse formalin pain model was repeated with a 1-hour pre-treatment dose of 5.0 mg/kg s.c. of [Glu20, Trp29]JzTx-V(1-29) (SEQ ID NO:112). (See, FIG. 59). The peptide had no effect on the time spent lifting/licking the affected paw in either the first phase (0-5 minutes post formalin injection) or second phase (5-40 minutes post formalin injection) compared to the vehicle (PBS). (See, FIG. 60 and FIG. 61). The positive control, a 3 mg/kg s.c. dose of morphine, did significantly reduce the time spent lifting/licking the affected paw in the first and second phases. Terminal exposure (peptide plasma concentration at 45 min post formalin injection) was 2.63±0.777 μM for the 5.0 mg/kg dose. This peptide plasma concentration is only about 10-fold over the IC50 of [Glu20,Trp29]JzTx-V(1-29) (SEQ ID NO:112) for blocking the TTX-S current in mouse DRG neurons in the WCPC format. It is likely that the in vivo Nav1.7 target coverage was insufficient to produce efficacy in this pain model.

Mouse Complete Freund's Adjuvant (CFA)—Induced Thermal Hyperalgesia Experimental Procedure.

The CFA-induced inflammatory pain model is a widely used animal model to study inflammatory pain mechanisms. The classical symptoms of this model are swelling of the CFA-injected paw (edema), redness, allodynia and hyperalgesia. These symptoms develop within 2-3 hours of CFA injection and last more than seven days.

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020X) and water and were maintained on a 12-h light/dark cycle for the entire duration of the study. All animals were housed on standard solid-bottomed caging with corn cob bedding with 1 animal per cage. The animal colony was maintained at approximately 21° C. and 60% humidity. All experiments were conducted in accordance with the International Association for the Study of Pain guidelines.

At test time, mice (n=12) were lightly restrained in a cloth glove and injected with 20 μL of CFA (Sigma Aldrich) into the intraplantar surface of the left hind paw using an insulin syringe (U100, 0.3 cc, 28-30G). Thermal latency to the Hargreaves apparatus (San Diego Instruments) was recorded 24 hours post CFA injection and again following investigational compound or vehicle administration. Following the thermal test both ipsilateral and contralateral paw widths were measured. After study completion animals were immediately euthanized.

Figure 62:
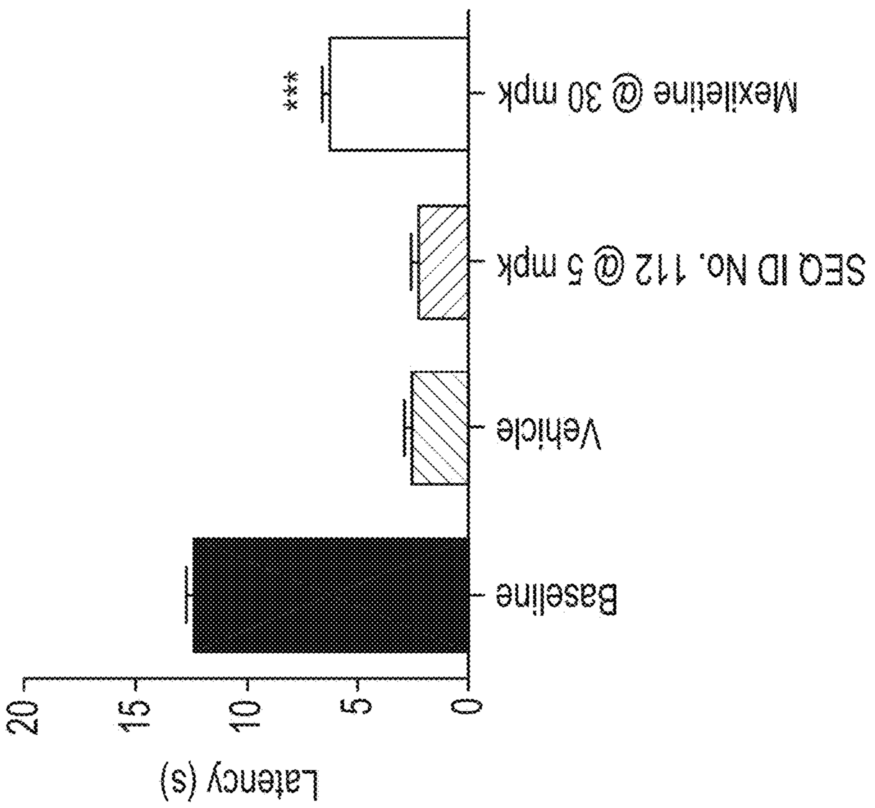
FIG. 62 shows the effect of [Glu20,Trp29]JzTx-V(1-29) (SEQ ID NO:112) in the Complete Freund's Adjuvant (CFA) thermal hyperalgesia pain model (24 h postdose) in male CD-1 mice with a dose of 5.0 mg/kg s.c. (n=10). After a lack of efficacy was observed at peptide doses ≤5 mg/kg in the formalin pain model, the peptide was tested in a second pain model. The peptide had no effect on thermal latency compared to vehicle (PBS). The positive control, a 30 mg/kg oral dose of mexilitine was sufficient to significantly reverse thermal hyperalgesia in the animals. The terminal plasma exposure (peptide plasma concentrations at 2 h post-peptide injection) for the peptide was 1.75±0.536 μM. Data Represent Mean±SEM; ***p<0.0001 by ANOVA/DUNNETTS; Outliers Removed (n=12).

The mouse CFA thermal hyperalgesia pain model (24 h postdose) in male CD-1 mice was run with a 5.0 mg/kg s.c. dose of [Glu20,Trp29]JzTx-V(1-29) (SEQ ID NO:112). After a lack of efficacy was observed at peptide doses ≤5 mg/kg in the formalin pain model, the peptide was tested in a second pain model. The peptide had no effect on thermal latency compared to vehicle (PBS). (See, FIG. 62). The positive control, a 30 mg/kg PO dose of mexilitine was sufficient to significantly reverse thermal hyperalgesia in the animals. The terminal plasma exposure (peptide plasma concentrations at 2 h post peptide injection) for the peptide was 1.75±0.536 μM. It is likely that the in vivo Nav1.7 target coverage was insufficient to produce efficacy in this pain model.

Mouse Open Field Analysis Experimental Protocol.

To verify that efficacy in the formalin model produced by a test compound is not due to sedation or damage to the animal, compounds were also tested for their effects on the overall movement of animals (open-field testing). Naïve animals are administered test compound and placed in a novel environment, and the movements the animal undergoes during exploration of the novel environment are automatically recorded. Reductions in movement of 50% or more mean that efficacy in the formalin test cannot be ascribed to true analgesia.

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020X) and water and were maintained on a 12-h light/dark cycle for the entire duration of the study. All animals were housed on standard solid-bottomed caging with corn cob bedding with 1 animal per cage. The animal colony was maintained at approximately 21° C. and 60% humidity. All experiments were conducted in accordance with the International Association for the Study of Pain guidelines.

On test day, animals were dosed with either an investigational compound or vehicle and given at least 30 minutes to acclimate to the testing room. Mice (N=10) were placed in a clean open field chamber (Kinder Scientific Photobeam Activity System) at the appropriate time after dose administration. The changes in overall animal movement were recorded on the system for 30 minutes under lights off conditions. The following parameters were evaluated: total basic movement, total rearing, total time rearing, and total fine movement.

Results of the Mouse Open Field Analysis.

Figure 63:
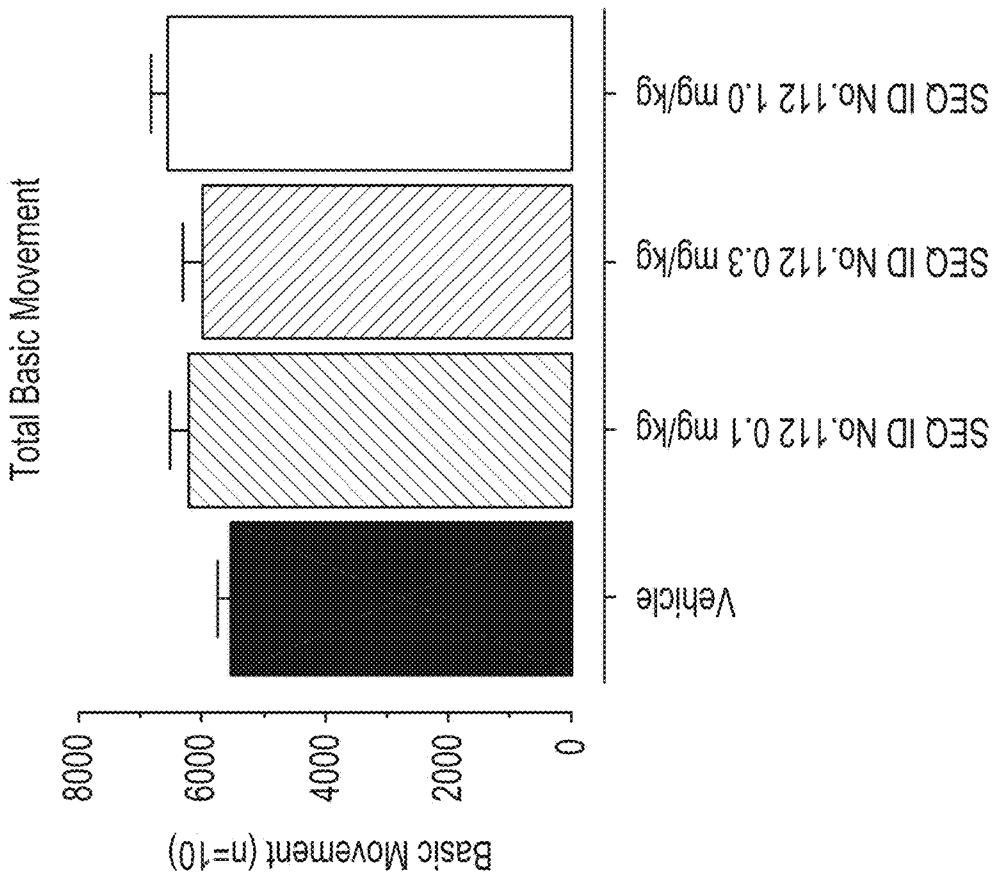
FIG. 63 shows the effects of [Glu20,Trp29]JzTx-V(1-29) (SEQ ID NO:112) at 0.1, 0.3, and 1.0 mg/kg s.c. doses with a 1-hour pre-treatment time on the total basic movement component of locomotor activity in male CD-1 mice. No doses of peptide significantly decreased exploratory behavior in relation to the vehicle control. Terminal exposures (peptide plasma concentrations at 2 h post peptide injection) were 0.0248±0.00668, 0.121±0.0296, and 0.419±0.226 μM for the 0.1, 0.3, and 1.0 mg/kg s.c. doses, respectively.
Figure 64:
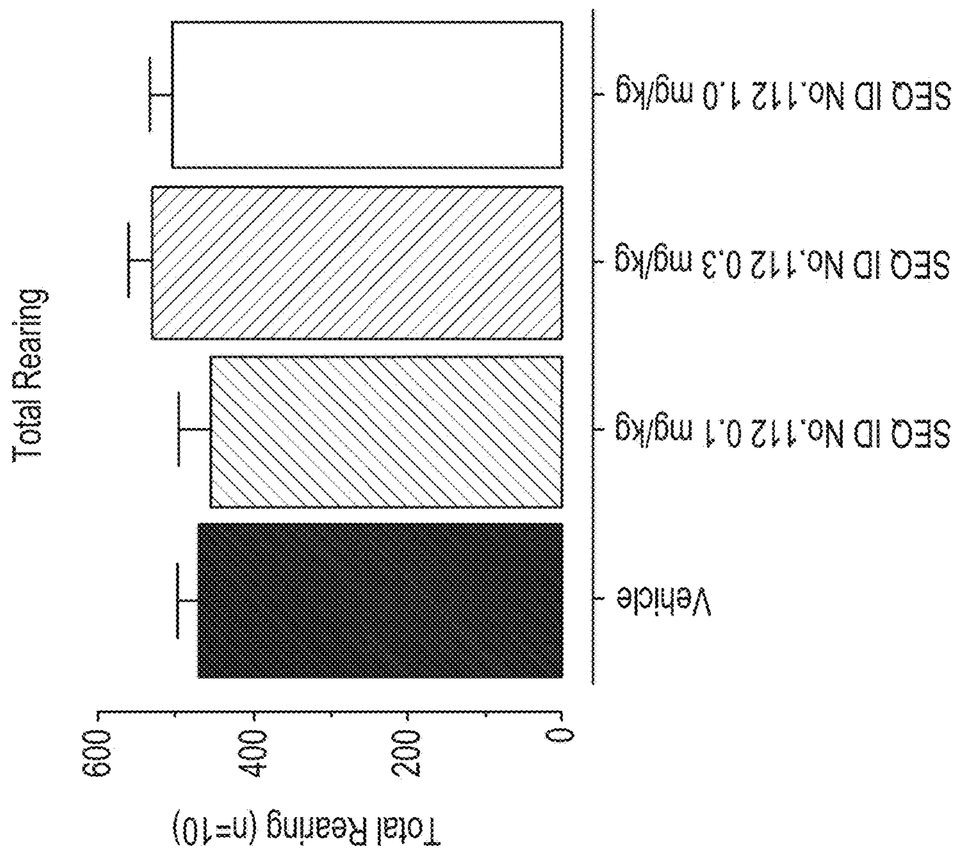
FIG. 64 shows the effects of [Glu20,Trp29]JzTx-V(1-29) (SEQ ID NO:112) at 0.1, 0.3, and 1.0 mg/kg s.c. doses with a 1-hour pre-treatment time on the total rearing component of locomotor activity in male CD-1 mice. No doses of peptide significantly decreased exploratory behavior in relation to the vehicle control.
Figure 65:
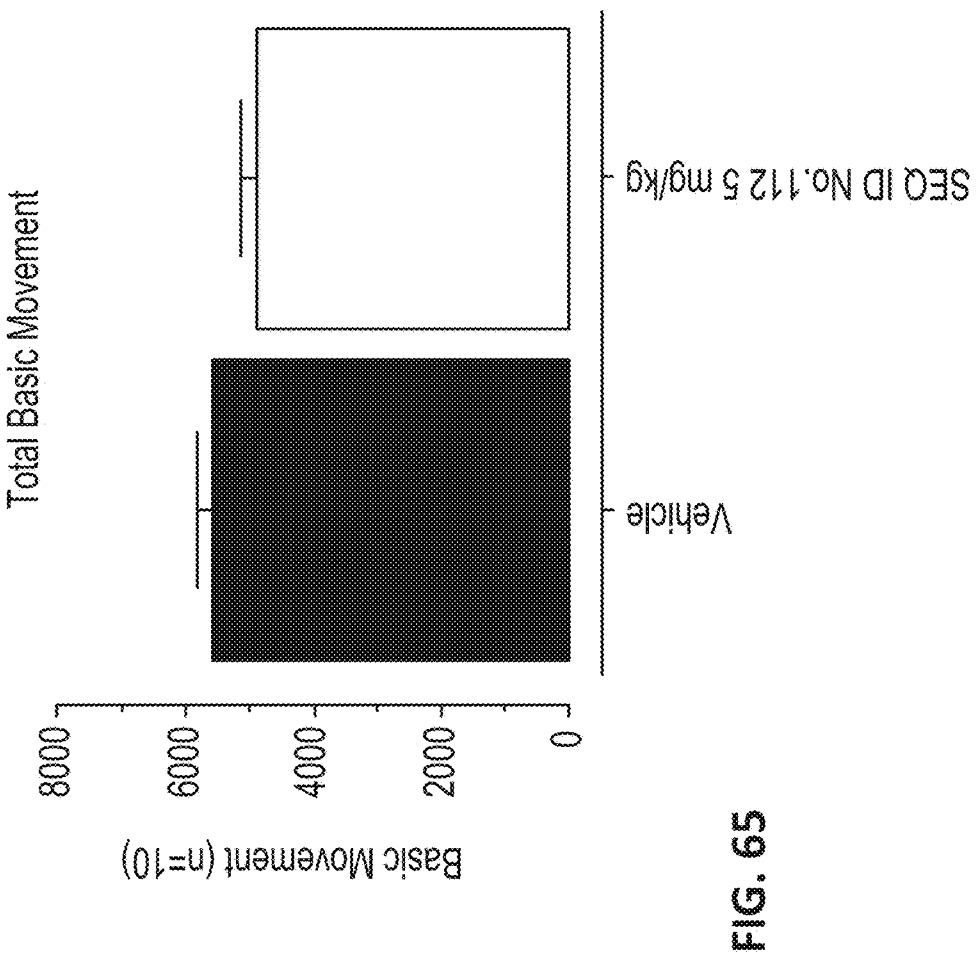
FIG. 65 shows the effects of [Glu20,Trp29]JzTx-V(1-29) (SEQ ID NO:112) at a 5.0 mg/kg s.c. dose with a 1-hour pre-treatment time on the total basic movement component of locomotor activity in male CD-1 mice. The dose of peptide did not significantly decrease exploratory behavior in relation to the vehicle control. Terminal exposure (peptide plasma concentrations at 2 h post peptide injection) was 4.73±0.584 μM for the 5.0 mg/kg s.c. dose.
Figure 66:
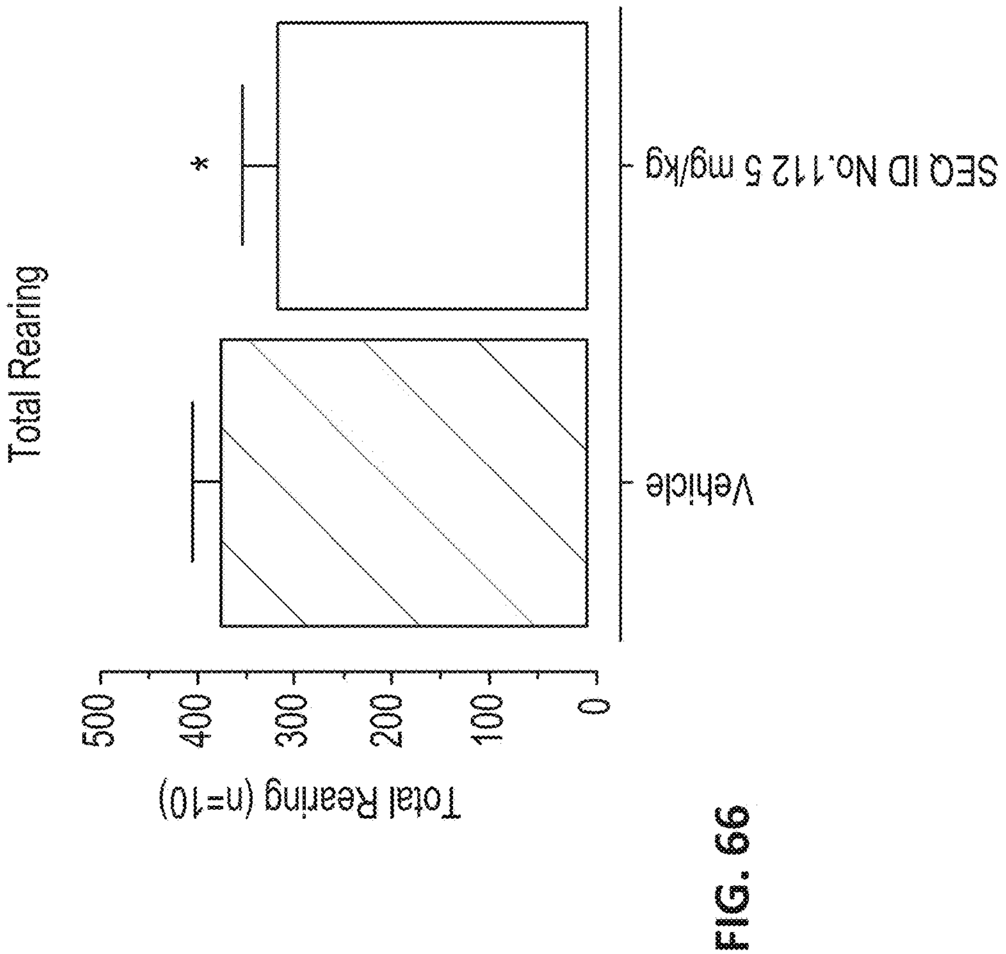
FIG. 66 shows the effects of [Glu20,Trp29]JzTx-V(1-29) (SEQ ID NO:112) at a 5.0 mg/kg s.c. dose with a 1-hour pre-treatment time on the total rearing component of locomotor activity in male CD-1 mice. The dose of peptide may have slightly decreased the rearing behavior in relation to the vehicle control.

[Glu20,Trp29]JzTx-V(1-29) (SEQ ID NO:112) at 0.1, 0.3, or 1.0 mg/kg s.c. doses with a 1-hour pre-treatment time had no effect on the total basic movement, total fine movement, total rearing, or total time rearing in CD-1 mice. None of these doses of peptide significantly decreased exploratory behavior in relation to the vehicle control. (See, FIG. 63 and FIG. 64). At a 5 mg/kg s.c. dose with a 1-hour pre-treatment, the peptide had no significant effect on the total basic movement of CD-1 mice relative to the vehicle. The peptide may have slightly reduced the total time rearing component of locomotor activity relative to the vehicle. (See, FIG. 65 and FIG. 66). Terminal exposures (peptide plasma concentrations at 2 h post-peptide injection) were 0.0248±0.00668, 0.121±0.0296, 0.419±0.226, and 4.73±0.584 μM for the 0.1, 0.3, 1.0, and 5.0 mg/kg s.c. doses, respectively. No observations were made at these doses and corresponding peptide plasma concentrations that would confound the experimental read out of the formalin or CFA pain models.

Rat Formalin Pain Model Experimental Procedure.

Formalin injection into a rodent paw evokes a well-studied form of pain quantitated by the number of times the animal flinches its paw. The pain following formalin injection comes in two characteristic phases: a first phase lasts approximately ten minutes and likely corresponds to the immediate pain mediated by peripheral neurons. The second phase, beginning approximately ten minutes after formalin injection and lasting for another 30 to 40 minutes, corresponds to sensitization of neurons in the spinal cord and hyperactivity of peripheral pain-sensing neurons. Compounds represented in this application were tested to see if they reduce the number of flinches in phase II of the formalin response and so are potential analgesic drugs (Bregman H et al., "Identification of a potent, state-dependent inhibitor of Nav1.7 with oral efficacy in the formalin model of persistent pain." J Med Chem 54(13):4427-4445, 2011).

Male Sprague-Dawley rats (10-12 weeks of age, Harlan Laboratories, Frederick, Md.) were used for all in vivo efficacy experiments. Animal subjects had free access to food (Teklad Global Soy Protein-Free Extruded Rodent Diet 2020X) and water and were maintained on a 12-h light/dark cycle for the entire duration of the study. All animals were housed on standard solid-bottomed caging with corn cob bedding in groups of 2 animals per cage. The animal colony was maintained at approximately 21° C. and 60% humidity. All experiments were conducted in accordance with the International Association for the Study of Pain guidelines.

On test day, during or before acclimation, the animals were dosed with either an investigational compound or vehicle. Following dose administration, all rats (n=8) were conditioned to behavioral analysis chambers (dimensions: 15 cm diameter, 30 cm tall cylinder) for 30 minutes prior to the formalin injection. At test time, rats were lightly restrained in a towel and injected with 50 μL of a 2.5% formalin solution into the dorsal surface of the left hind paw using an insulin syringe (U100, 0.3 cc, 28-30G). A soft metal band (10 mm wide 3×27 mm long, shaped into a C, and weighing 0.5 g) was placed on the left hind paw and glued onto the animal being tested Immediately following the formalin injection, animals were returned to the chamber on the automated flinch-detecting system (T. Yaksh, University of California at San Diego, La Jolla, Calif.). Each animal's flinch count value over an interval of time (1 min), for the duration of the study (40 min), forms the data set used in all subsequent analyses. These data are averaged in the phase 1 and phase 2 formalin intervals after which ipsilateral and contralateral paw widths were measured. After study completion animals were immediately euthanized.

Rat Formalin Model Results.

Figure 67:
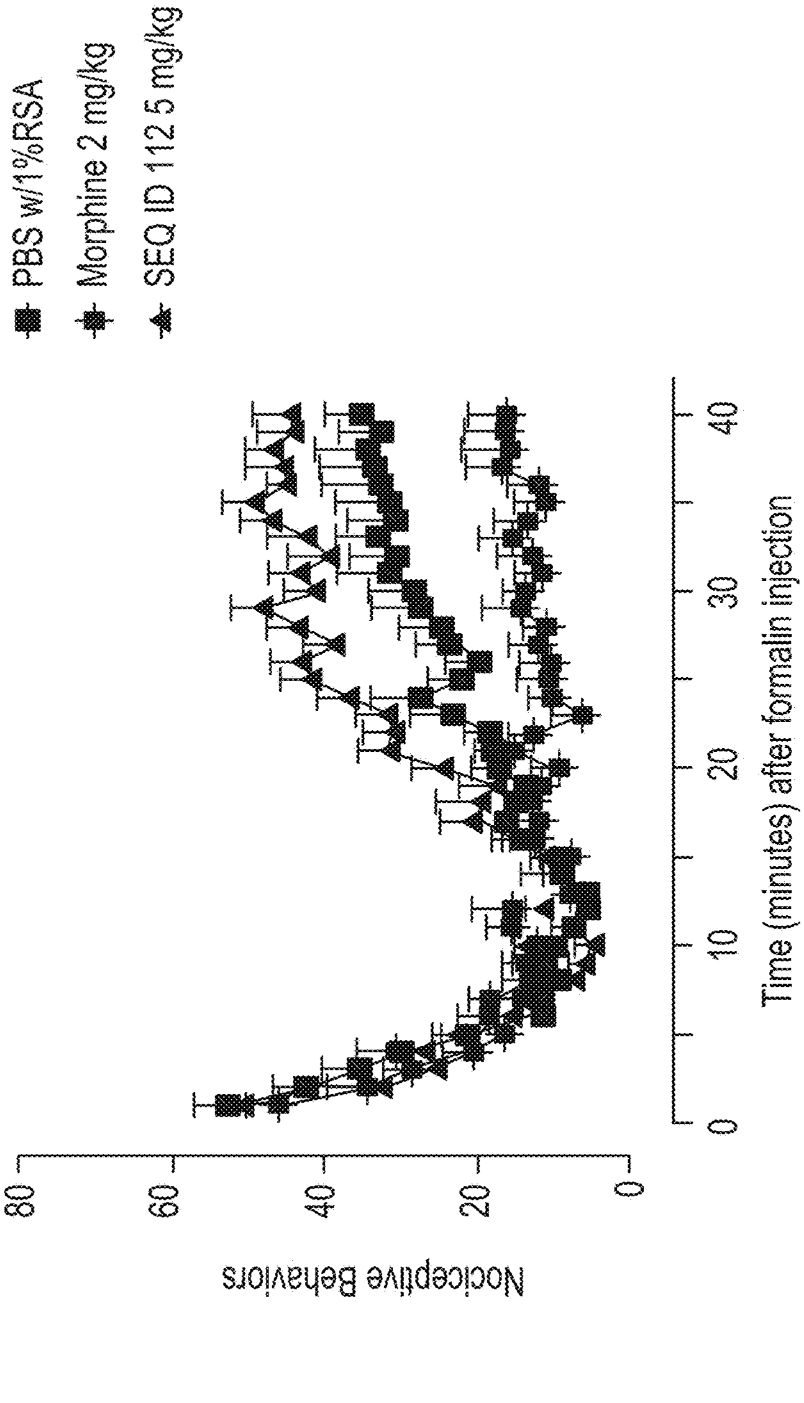
FIG. 67 shows the timecourse of the effect of [Glu20,Trp29]JzTx-V(1-29) (SEQ ID NO:112) in the formalin pain model in male Sprague-Dawley rats with a 1-hour pre-treatment dose of 5.0 mg/kg s.c. (n=8). After a lack of efficacy was observed at peptide doses ≤5 mg/kg in mice, the formalin pain model was repeated at a 5 mg/kg dose in a second species, Sprague-Dawley rats. The peptide had no effect in the first or acute phase (0-5 minutes post formalin injection). The peptide did not decrease and may have actually increased the time spent lifting and/or licking the affected paw during the second phase (5-40 minutes post formalin injection, associated with spinal sensitization) compared to vehicle (PBS). The positive control, a 2 mg/kg s.c. dose of morphine (n=8) was sufficient to significantly reduce pain response in the animals. The terminal plasma exposure (peptide plasma concentrations at 45 min post-formalin injection) for the peptide was 1.18±0.156 μM.
Figure 68:
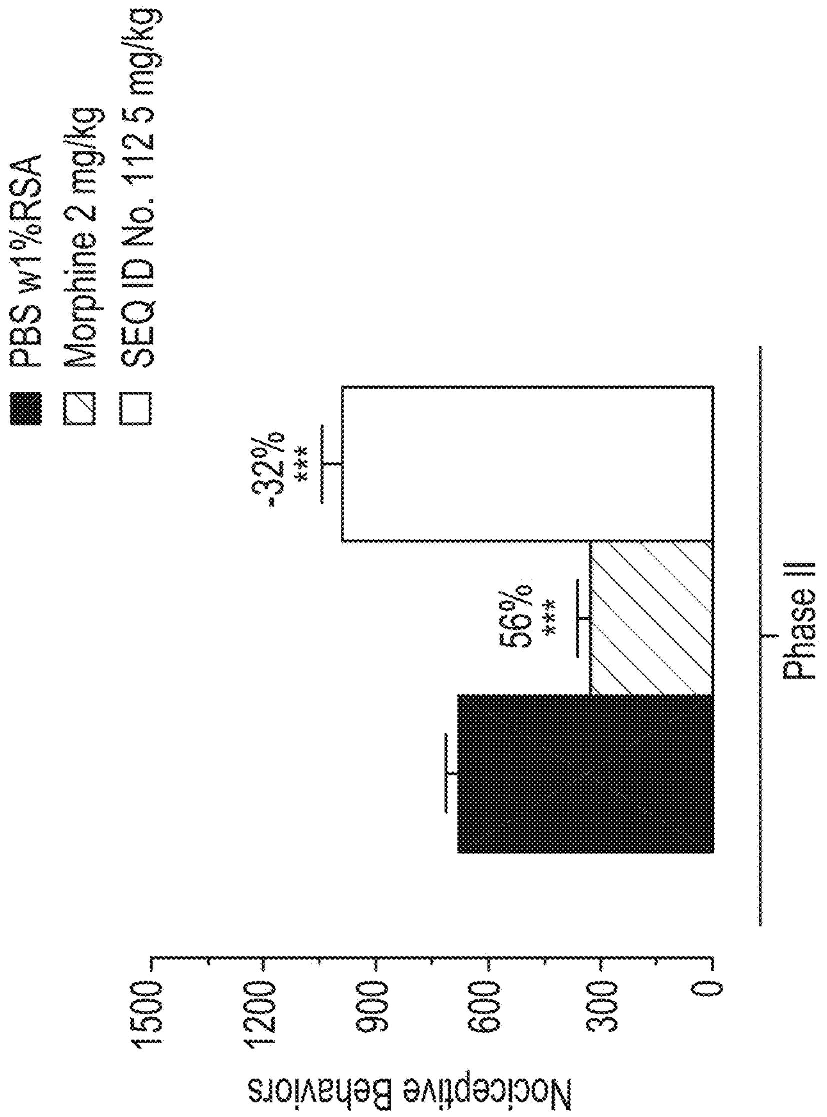
FIG. 68 shows the effect of [Glu20,Trp29]JzTx-V(1-29) (SEQ ID NO:112) in the formalin pain model in male Sprague-Dawley rats with a 1-hour pre-treatment dose of 5.0 mg/kg s.c. (n=8) during the second phase (5-40 minutes post formalin injection). The morphine control (s.c., 2 mg/kg, 30' preTx, n=8), but not the peptide, significantly reduced the time spent lifting and/or licking the affected paw during the second phase. The peptide may have actually increased the pain response in the second phase of the formalin study. Data Represent Mean±SEM; ***p<0.0001 by ANOVA/DUNNETTS.

[Glu20,Trp29]JzTx-V(1-29) (SEQ ID NO:112) was tested in the formalin pain model in male Sprague-Dawley rats with a 1-hour pre-treatment dose of 5.0 mg/kg s.c. After a lack of efficacy was observed at peptide doses <5 mg/kg in mice, the formalin pain model was repeated at a 5 mg/kg dose in a second species, Sprague-Dawley rats. The peptide had no effect in the first or acute phase (0-5 minutes post formalin injection). The peptide did not decrease and may have actually increased the time spent lifting and/or licking the affected paw during the second phase (5-40 minutes post formalin injection, associated with spinal sensitization) compared to vehicle (PBS). (See, FIG. 67 and FIG. 68). The positive control, a 2 mg/kg s.c. dose of morphine was sufficient to significantly reduce pain response in the animals. The terminal plasma exposure (peptide plasma concentrations at 45 min post-formalin injection) for the peptide was 1.18±0.156 μM. It is likely that the in vivo Nav1.7 target coverage at this peptide plasma concentration was insufficient to produce efficacy in this pain model.

Rat Open Field Analysis Experimental Protocol.

To verify that efficacy in the formalin model produced by a test compound is not due to sedation or damage to the animal, compounds were also tested for their effects on the overall movement of animals (open-field testing). Naïve animals are administered test compound and placed in a novel environment, and the movements the animal undergoes during exploration of the novel environment are automatically recorded. Reductions in movement of 50% or more mean that efficacy in the formalin test cannot be ascribed to true analgesia.

Male Sprague-Dawley rats (10-12 weeks of age, Harlan Laboratories, Frederick, Md.) were used for all in vivo efficacy experiments. Animal subjects had free access to food (Teklad Global Soy Protein-Free Extruded Rodent Diet 2020X) and water and were maintained on a 12-h light/dark cycle for the entire duration of the study. All animals were housed on standard solid-bottomed caging with corn cob bedding in groups of 2 animals per cage. The animal colony was maintained at approximately 21° C. and 60% humidity. All experiments were conducted in accordance with the International Association for the Study of Pain guidelines.

On test day, animals were dosed with either an investigational compound or vehicle and given at least 30 minutes to acclimate to the testing room. Rats (N=8) were placed in a clean open field chamber (Photobeam Activity System, San Diego Instruments) at the appropriate time after dose administration. The changes in overall animal movement were recorded on the system for 30 minutes under lights off conditions. The following parameters were evaluated: total basic movement, total rearing, total time rearing, and total fine movement.

Rat Open Field Analysis Results.

Figure 69:
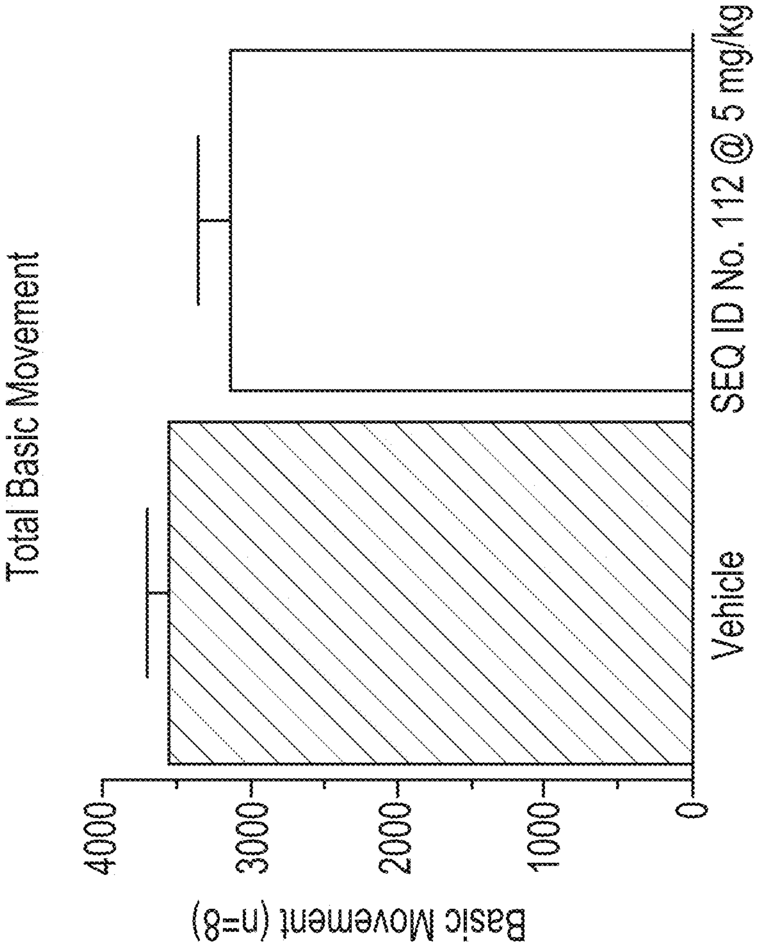
FIG. 69 shows the effects of [Glu20,Trp29]JzTx-V(1-29) (SEQ ID NO:112) at a 5.0 mg/kg s.c. dose with a 1-hour pre-treatment time on the total basic movement component of locomotor activity (tested in light-off condition) in male Sprague-Dawley rats (9 weeks of age). The dose of peptide did not significantly decrease exploratory behavior in relation to the vehicle control. Terminal exposure (peptide plasma concentrations at 2 h post peptide injection) was 0.994±0.184 μM for the 5.0 mg/kg s.c. dose. Data Represent Mean±SEM, n=8.
Figure 70:
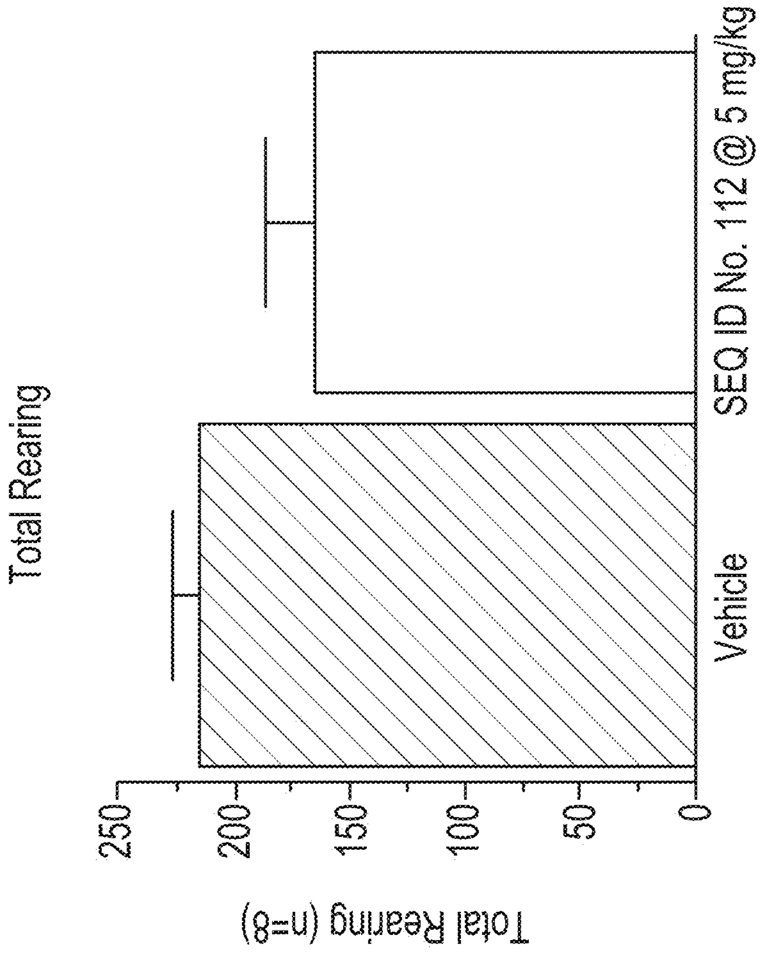
FIG. 70 shows the effects of [Glu20,Trp29]JzTx-V(1-29) (SEQ ID NO:112) at a 5.0 mg/kg s.c. dose with a 1-hour pre-treatment time on the total rearing component of locomotor activity (tested in light-off condition) in male Sprague-Dawley rats (9 weeks of age). The dose of peptide did not significantly decrease exploratory behavior in relation to the vehicle control. Data Represent Mean±SEM, n=8.
Figure 71:
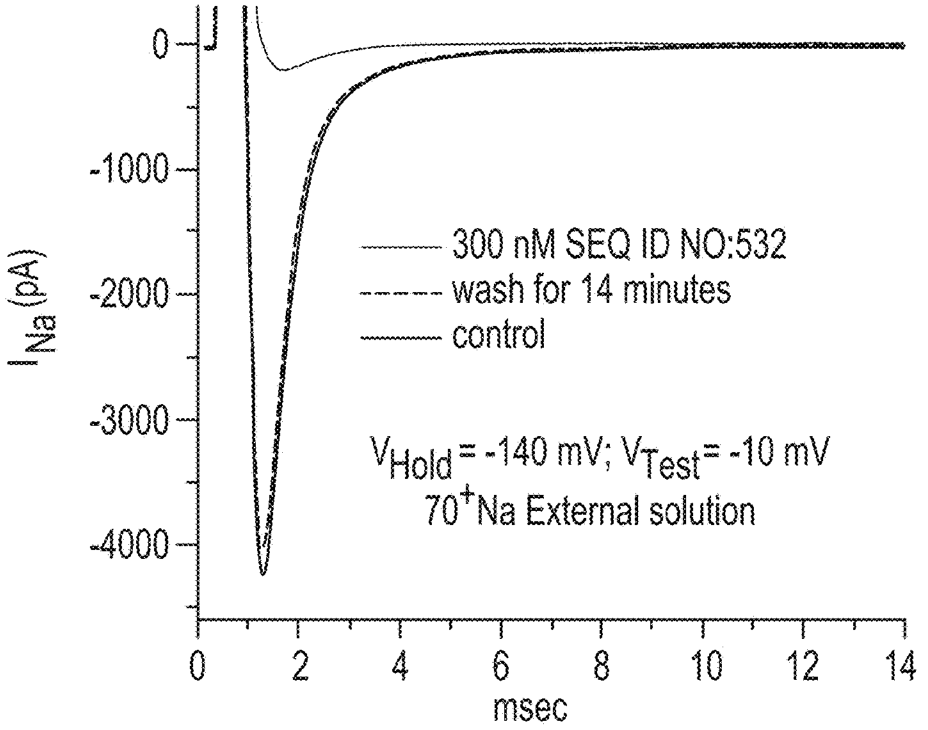
FIG. 71 shows representative block of Nav1.7 current with administration of 300 nM concentration of monomeric peptide GpTx-1 (SEQ ID NO:532 by manual electrophysiology (Nav1.7 whole cell patch clamp [WCPC] $IC_{50}$=0.003 μM).
Figure 72:
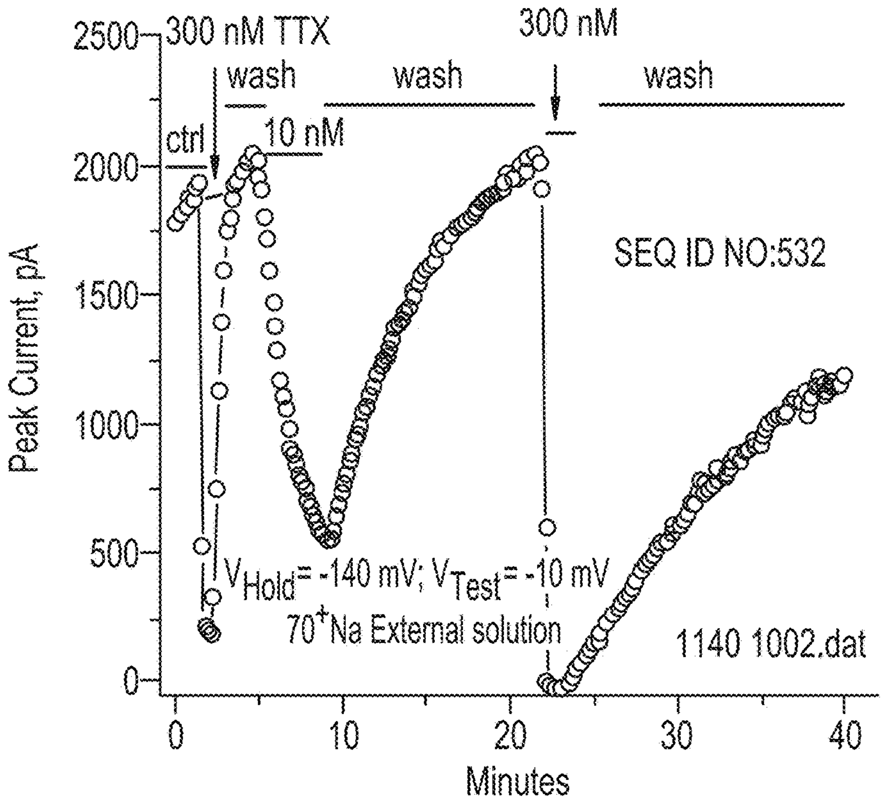
FIG. 72 shows a representative time course of block of Nav1.7 current by addition of 10 and 300 nM concentrations of monomeric peptide GpTx-1 (SEQ ID NO:532 by manual electrophysiology (WCPC). Note the washout of peptide and recovery of current over time.

[Glu20,Trp29]JzTx-V(1-29) (SEQ ID NO:112) at a 5.0 mg/kg s.c. dose with a 1-hour pre-treatment time had no significant effect on the total basic movement or total rearing components of locomotor activity in male Sprague-Dawley rats. The dose of peptide did not significantly decrease exploratory behavior in relation to the vehicle control. (See, FIG. 69 and FIG. 70). Terminal exposure (peptide plasma concentrations at 2 h post peptide injection) was 0.994±0.184 μM for the 5.0 mg/kg s.c. dose.

The foregoing example of in vivo pain models for the screen of therapeutic embodiments of the inventive molecules are non-limiting. The skilled practitioner is aware of other relevant pain models.

Example 9: Site Specific Peptide Conjugation

The following protocol was used to site-specifically conjugate a dimeric toxin peptide analog (see, Table 5 for toxin peptide analog amino acid sequences) to a human immunoglobulin at a linkage site on the heavy chain (C273 of SEQ ID NO:542).

Preparation of Peptide-Linker Construct.

Alkyne-containing peptide Pra-[Nle6]JzTx-V(1-29) (SEQ ID NO:425) was subjected to copper catalyzed 1,3-dipolar cycloaddition with a Bis-{azido-PEG23-ethyl}-5-((2-bromoacetamido)methyl)isophthalamide to obtain the site-specifically PEGylated peptide dimer with triazole linkages, thus converting a propargylglycine or Pra residue in each sequence to a 3-(1,2,3-triazol-4-yl)alanine or Atz residue to yield Atz-[Nle6]JzTx-V (SEQ ID NO:571 as set forth in Table 5). (See, FIGS. 76A-B and FIG. 81A). Peptide containing propargylglycine (Pra) at the N-terminus (7.4 mM in 2.12 mL water), Bis-{azido-PEG23}-5-((2-bromoacetamido)methyl)isophthalamide (150 mM, 0.127 mL in water), tris((1-benzyl-1H-1,2,3-triazol-4-yl)methyl)amine (TBTA, 10 mM, 1.3 mL in DMSO), sodium ascorbate (50 mM, 5.1 mL in water), and copper (II) sulfate (35 mM, 0.8 mL in water) solutions were prepared fresh. Peptide and reagents were added in the following order to a 50 mL centrifuge tube to achieve the following final concentrations. Peptide stock solution (2.1 mL) was added for a final concentration of 3.7 mM, followed by addition of Bis-{azido-PEG23}-5-((2-bromoacetamido)methyl)isophthalamide (0.064 mL) for a final concentration of 2.25 mM. TBTA (0.191 mL) was added for a final concentration of 0.45 mM and mixed thoroughly. Sodium ascorbate (1.431 mL) was then added for a final concentration of 16.9 mM and mixed thoroughly. $CuSO_4$ (0.409 mL) was added for a final concentration of 3.4 mM. Additional peptide solution was added (0.4 mL of 7.4 mM stock) after 15 minutes. The solution was allowed to stand for 1 h at which time it was judged to be complete by LC-MS. The product mixture was purified by injecting onto a preparative HPLC column (Phenomenex Luna 5u C18(2) 100A AXIA, 250×30 mm) attached to a prep HPLC (Agilent), and the peptide was eluted with a 10-40% B gradient over 60 min, followed by a 10 min flush and a 10 min equilibration. The fractions were analyzed by LC-MS, pooled, and lyophilized to afford pure peptide-linker construct for conjugation to IgG or Fc domain. An analogous set of reactions was performed with appropriate peptide starting materials and linkers (i.e., {PEG11-ethyl}-bromoacetamide) to prepare other peptide-linker constructs with linkers attached at the N-terminus (SEQ ID NO:885), SEQ ID NO:571 and SEQ ID NO:893), position 1 (SEQ ID NO:1694), the side chain of lysine at position 14 (SEQ ID NO:892), and position 17 (SEQ ID NO:889). (See, Table 21).

Antibody Preparation/Reduction.

Anti-DNP mAb (E273C, hIgG1) (kappa/IgG1z) was concentrated to ~5 mg/ml in reaction buffer (20 mM sodium phosphate pH 6.8, 2 mM EDTA).

The amino acid sequence of the human IgG heavy chain monomer that was used was the following (variable region is underlined; C273 linkage site is italicized and underlined):

SEQ ID NO.: 542

QVQLVESGGGVVQPGRSLRLSCAASGFTFSSYGMHWVRQAPGKGLEW

VAVIWYDGSNKYYADSVKGRFTISRDNSKNTLYLQMNSLRAEDTAVY

YCARYNFNYGMDVWGQGTTVTVSSASTKGPSVFPLAPSSKSTSGGTA

ALGCLVKDYFPEPVTVSWNSGALTSGVHTFPAVLQSSGLYSLSSVVT

VPSSSLGTQTYICNVNHKPSNTKVDKKVEPKSCDKTHTCPPCPAPEL

LGGPSVFLFPPKPKDTLMISRTPEVTCVVVDVSHEDPCVKFNWYVDG

VEVHNAKTKPREEQYNSTYRVVSVLTVLHQDWLNGKEYKCKVSNKAL

PAPIEKTISKAKGQPREPQVYTLPPSREEMTKNQVSLTCLVKGFYPS

DIAVEWESNGQPENNYKTTPPVLDSDGSFFLYSKLTVDKSRWQQGNV

FSCSVMHEALHNHYTQKSLSLSPGK//.

The amino acid sequence of the human IgG kappa light chain monomer that was used was the following (variable region is underlined):

SEQ ID NO.: 543

DIQMTQSPSSVSASVGDRVTITCRASQGISRRLAWYQQKPGKAPKLL

IYAASSLQSGVPSRFSGSGSGTDFTLTISSLQPEDFATYYCQQANSF

PFTFGPGTKVDIKRTVAAPSVFIFPPSDEQLKSGTASVVCLLNNFYP

REAKVQWKVDNALQSGNSQESVTEQDSKDSTYSLSSTLTLSKADYEK

HKVYACEVTHQGLSSPVTKSFNRGEC//.

The amino acid sequence of the human IgG1z Fc domain monomer that was used was the following (C52 linkage site is italicized and underlined):

SEQ ID NO.: 544

DKTHTCPPCPAPELLGGPSVFLFPPKPKDTLMISRTPEVTCVVVDVS

HEDPCVKFNWYVDGVEVHNAKTKPREEQYNSTYRVVSVLTVLHQDWL

NGKEYKCKVSNKALPAPIEKTISKAKGQPREPQVYTLPPSREEMTKN

QVSLTCLVKGFYPSDIAVEWESNGQPENNYKTTPPVLDSDGSFFLYS

KLTVDKSRWQQGNVFSCSVMHEALHNHYTQKSLSLSPGK//.

Alternative preferred conjugation sites within the human IgG heavy chain monomer, besides E273C in the CH2 domain, are E89C in the VH domain and T360C in the CH3 domain and the analogous site in the IgG1z Fc domain. Additional conjugation sites within the human IgG heavy chain monomer are A119C, S125C, E153C, D266C, Y301C, E346C, M359C, N362C, Q363C, E389C, N391C, D414C, S416C, and S443C and the analogous site E346C, N362C, Q363C, N391C, L399C, and D414C in the IgG1z Fc domain. An alternative preferred conjugation site within the human IgG kappa light chain monomer is D70C in the VL domain. Additional conjugation sites within the human IgG kappa light chain monomer are V110C or A112C. These sequences may (SEQ ID NO:1718-1740) or may not (SEQ ID NO:1741-1742) contain the N298G mutation in the IgG heavy chain monomer or IgG1z Fc domain.

TABLE 21

Immunoglobulin-JzTx-V peptide conjugates were made. (See FIG. 81B). Some of the "bivalent" conjugate molecules actually had four toxin peptides (i.e., peptide dimer covalently conjugated via linker to each Fc domain monomer in the molecule) in the molecule.

| Designation | SEQ ID NO of toxin peptide | Linker and residue position of linkage on toxin peptide | SEQ ID NOS of immuno-globulin mono-mers in conju-gated molecule | Monovalent or Bivalent |
|---|---|---|---|---|
| Immunoglobulin-Peptide Conjugate 1 | 571 | Bis-{PEG23-ethyl}-5-((2-bromoacetamido)methyl)isophthalamide at N-terminus [See, FIG. 78B] | 542; 543; 542; 543 | bivalent |
| Immunoglobulin-Peptide Conjugate 2 | 885 | Bis-{PEG23-ethyl}-5-((2-bromoacetamido)methyl)isophthalamide at N-terminus | 542; 543; 542; 543 | Bivalent |
| Immunoglobulin-Peptide Conjugate 3 | 889 | Bis-{PEG23-ethyl}-5-((2-bromoacetamido)methyl)isophthalamide at Atz17 | 542; 543; 542; 543 | Bivalent |
| Immunoglobulin-Peptide Conjugate 4 | 892 | Bis-{PEG23-ethyl}-5-((2-bromoacetamido)methyl)isophthalamide at Lys(Atz)14 | 542; 543; 542; 543 | Bivalent |
| Immunoglobulin-Peptide Conjugate 5 | 889 | Bis-{PEG23-ethyl}-5-((2-bromoacetamido)methyl)isophthalamide at Atz17 | 542; 543; 542; 543 | Monovalent |
| Immunoglobulin-Peptide Conjugate 6 | 885 | Bis-{PEG23-ethyl}-5-((2-bromoacetamido)methyl)isophthalamide at N-terminus | 542; 543; 542; 543 | Monovalent |
| Immunoglobulin-Peptide Conjugate 7 | 889 | {PEG 11-ethyl}-bromoacetamide at Atz17 | 542; 543; 542; 543 | Bivalent |
| Immunoglobulin-Peptide Conjugate 8 | 885 | {PEG 11-ethyl}-bromoacetamide at N-terminus | 542; 543; 542; 543 | Bivalent |
| Immunoglobulin-Peptide Conjugate 9 | 571 | {PEG 11-ethyl}-bromoacetamide at N-terminus | 542; 543; 542; 543 | Bivalent |
| Immunoglobulin-Peptide Conjugate 10 | 892 | {PEG 11-ethyl}-bromoacetamide at Lys(Atz)14 | 542; 543; 542; 543 | Bivalent |
| Immunoglobulin Fc-Peptide Conjugate 11 | 889 | {PEG 11-ethyl}-bromoacetamide at Atz17 | 544; 544 | Bivalent |
| Immunoglobulin Fc-Peptide Conjugate 12 | 889 | Bis-{PEG23-ethyl}-5-((2-bromoacetamido)methyl)isophthalamide at Atz17 | 544; 544 | Bivalent |
| Immunoglobulin Fc-Peptide Conjugate 13 | 889 | Bis-{PEG23-ethyl}-5-((2-bromoacetamido)methyl)isophthalamide at Atz17 | 544; 544 | Monovalent |
| Immunoglobulin Fc-Peptide Conjugate 14 | 892 | Bis-{PEG23-ethyl}-5-((2-bromoacetamido)methyl)isophthalamide at Lys(Atz)14 | 544; 544 | Bivalent |
| Immunoglobulin Fc-Peptide Conjugate 15 | 885 | Bis-{PEG23-ethyl}-5-((2-bromoacetamido)methyl)isophthalamide at N-terminus | 544; 544 | Bivalent |
| Immunoglobulin Fc-Peptide Conjugate 16 | 889 | Bis-{PEG23-ethyl}-5-((2-bromoacetamido)methyl)isophthalamide at Atz17 | 1741; 1741 (Table 5A) | Monovalent |
| Immunoglobulin-Peptide Conjugate 17 | 889 | Bis-{PEG23-ethyl}-5-((2-bromoacetamido)methyl)isophthalamide at Atz17 | 1742; 1695; 1742; 1695 (Table 5A) | Monovalent |
| Immunoglobulin-Peptide Conjugate 18 | 889 | Bis-{PEG23-ethyl}-5-((2-bromoacetamido)methyl)isophthalamide at Atz17 | 1743; 1744; 1743; 1744 (Table 5A) | Monovalent |

TABLE 21-continued

Immunoglobulin-JzTx-V peptide conjugates were made. (See FIG. 81B). Some of the "bivalent" conjugate molecules actually had four toxin peptides (i.e., peptide dimer covalently conjugated via linker to each Fc domain monomer in the molecule) in the molecule.

| Designation | SEQ ID NO of toxin peptide | Linker and residue position of linkage on toxin peptide | SEQ ID NOS of immunoglobulin monomers in conjugated molecule | Monovalent or Bivalent |
|---|---|---|---|---|
| Immunoglobulin-Peptide Conjugate 19 | 889 | (2S)-2-(2-(2-(2-(2-bromoacetamido)acetamido)acetamido)-3-hydroxypropanamido)butanamide at Atz17 | 542; 543; 542; 543 | Bivalent |
| Immunoglobulin-Peptide Conjugate 20 | 889 | {PEG 11-ethyl}-bromoacetamide at Atz17 | 1743; 1744; 1743; 1744 (Table 5A) | Bivalent |
| Immunoglobulin-Peptide Conjugate 21 | 893 | {PEG 11-ethyl}-bromoacetamide at Atz17 | 542; 543; 542; 543 | Bivalent |
| Immunoglobulin-Peptide Conjugate 22 | 1694 | {PEG 11-ethyl}-bromoacetamide at Atz1 | 542; 543; 542; 543 | Bivalent |

Experimental Procedure for Preparation of Immunoglobulin Peptide Conjugate 1 by Partial Reduction Method.

Reduction of engineered cysteines was done by incubating mAb with a 1:1 molar ratio of TCEP to cysteine (2:1 TCEP to mAb) at room temperature for 30 minutes. TCEP was removed using a Zeba spin desalting column (≥7 kD Pierce) equilibrated with reaction buffer. Large scale preps were concentrated to appropriate volume prior to loading using amicon ultra (10,000-30,000MWCO) centrifugal concentrators.

Peptide Preparation.

Lyophilized dimeric peptide-linker containing a bromoacetamide functionality was resuspended in water at 20 mg/ml immediately prior to conjugation reaction.

Conjugation Reaction.

Peptide dimer and reduced mAb were mixed at a 2.5:1 molar ratio of peptide dimer to cysteine (5:1 peptide to mAb) in reaction buffer at mAb concentration of 10 mg/ml and incubated for 12-16 hours at 4° C. The engineered free cysteines in the immunoglobulin react with the bromoacetamide functionality in peptide-linker to form a site-specific immunoglobulin-peptide conjugate with a stable thioacetamide linkage. (See, FIG. 79A-B, FIG. 81B and FIG. 81C). If one cysteine reacts, then the result is a monovalent immunoglobulin-peptide conjugate, and if both cysteines react, then the result is a bivalent immunoglobulin-peptide conjugate.

Purification of Conjugates.

Figure 92A:
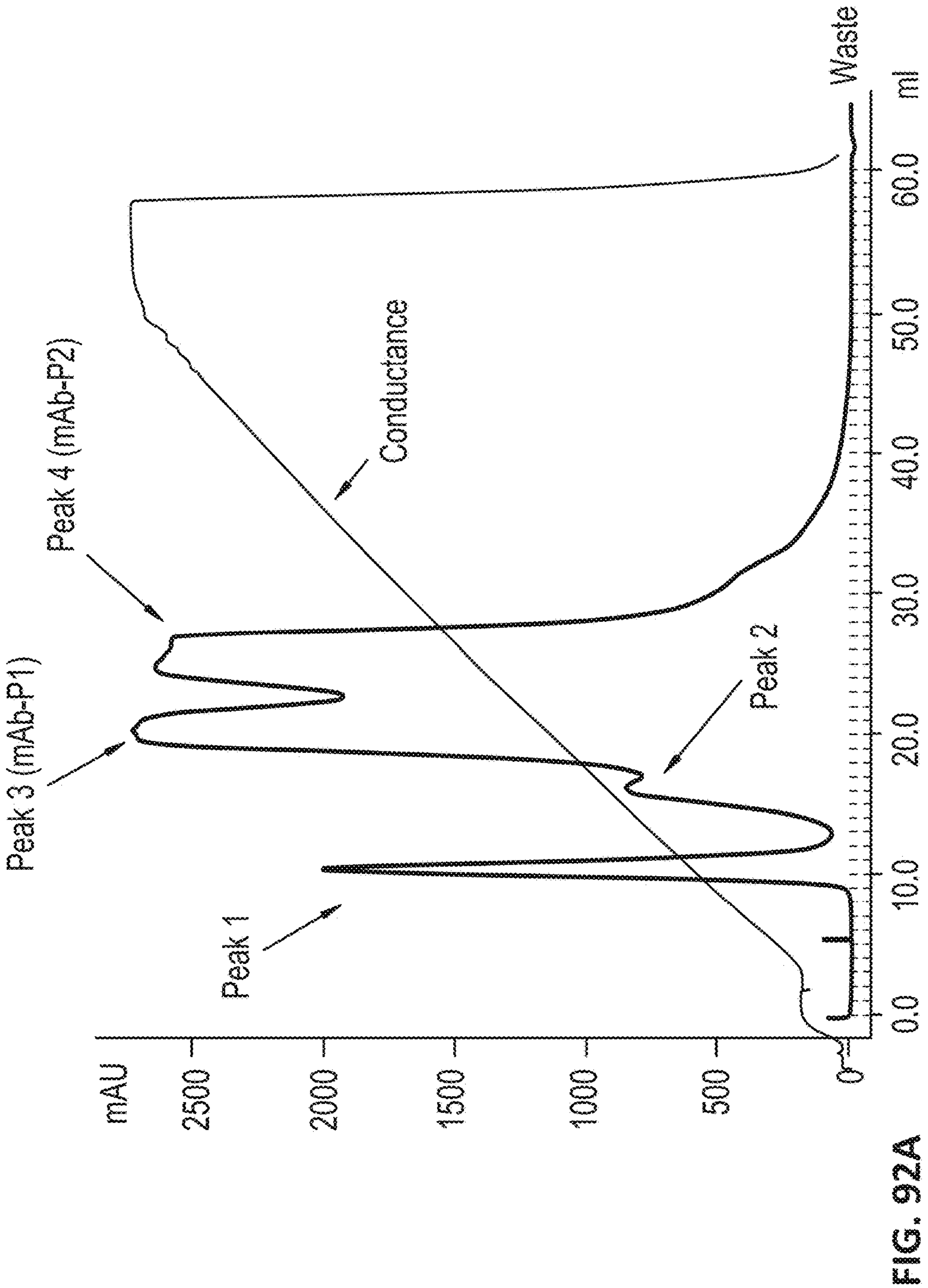
FIG. 92A-B shows the results from the purification of the site specific conjugation reaction mixture of peptide-linker construct (Homodimeric Peptide No. 1) with anti-DNP mAb (E273C) hIgG1 (comprising immunoglobulin monomers SEQ ID NO:542; SEQ ID NO:543; SEQ ID NO:542; SEQ ID NO:543; see, Example 9 and Table 21).
Figure 92B:
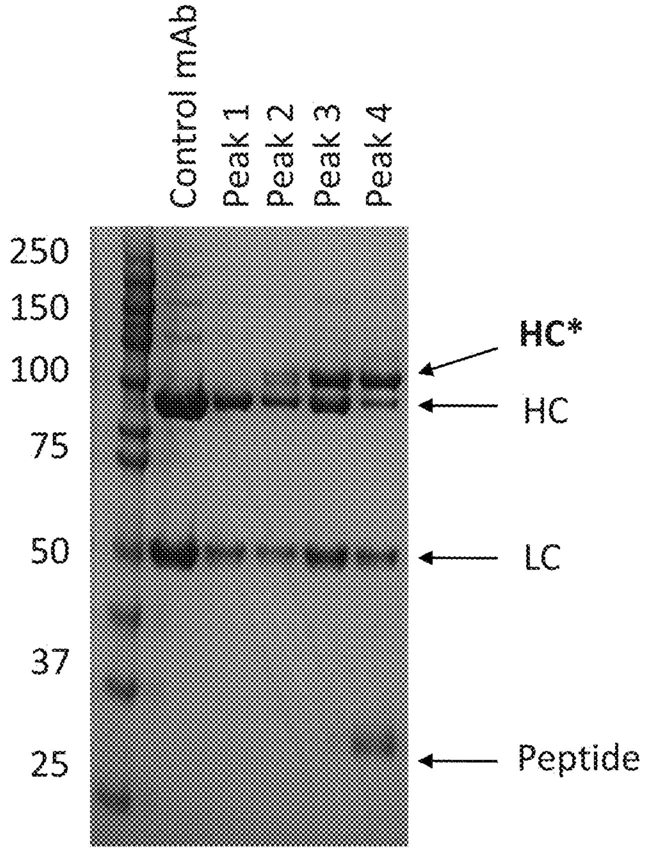

Following incubation, conjugation reaction was desalted to removed excess free peptide and loaded onto a HiTrap SP-HP column (GE Healthcare; 1 ml column for preps <10 mg, 5 ml column for preps >10 mg). Column was rinsed in 5 column volumes of 90% buffer A (10 mM sodium phosphate pH 6.5, 5% ethanol) 10% buffer B (10 mM sodium phosphate pH 6.5, 5% ethanol, 1M NaCl). Conjugate (see, Table 21) was eluted over a 20 column volume gradient from 10% buffer B to 70% buffer B. Unmodified mAb elutes first followed by monvalent immunoglobulin-peptide conjugate (1 peptide per mAb), followed by bivalent immunoglobulin-peptide conjugate (2 peptides per mAb). Higher order conjugates resulting from over reduction of the mAb elute later. (See, FIG. 92A-B). Following purification, conjugates were formulated into A5SU storage buffer (10 mM sodium acetate pH 5.0, 9% sucrose) and concentrated to 10 mg/ml to be stored at −80° C.

Analysis of Conjugate.

Figure 93:
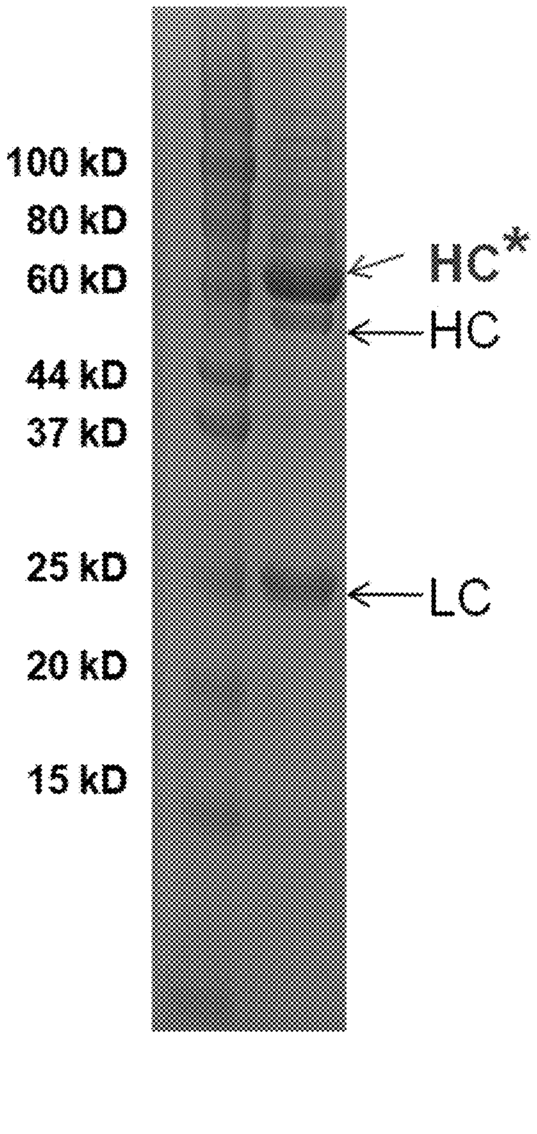
FIG. 93 shows a reducing SDS-PAGE gel of Immunoglobulin Peptide Conjugate 1 from the site specific conjugation reaction of peptide-linker construct (Homodimeric Peptide No. 1, see Example 5) with anti-DNP mAb (E273C) hIgG1 (comprising immunoglobulin monomers SEQ ID NO:542; SEQ ID NO:543; SEQ ID NO:542; SEQ ID NO:543, see Example 9) following purification on the SP-column.

Conjugate was run on reducing SDS-PAGE to confirm conjugation to heavy chain (increase in size by ~10 kD) and non-reducing SDS-PAGE to confirm internal disulfides remained intact. (See, FIG. 93).

Specific Reaction Results.

From 15 mg of Anti-DNP mAb (E273C, hIgG1; SEQ ID NO:542; SEQ ID NO:543; SEQ ID NO:542; SEQ ID NO:543) and 7 mg of peptide-linker construct ("Homodimeric Peptide No. 1", i.e., Bis-{Atz(PEG23*)-[Nle6]JzTx-V(1-29)}-5-(2-bromoacetamido)methyl)isophthalamide, see Example 5) were obtained 5 mg of bivalent conjugate ("Immunoglobulin Peptide Conjugate 1", see Table 21). Sample was concentrated to 10 mg/mL in A5SU buffer and stored as aliquots at −80° C. Immunoglobulin Peptide Conjugate 1 was tested in the Nav1.7 and Nav1.4 PX assays and found to be potent against both channels with IC50 values of 0.2 nM for both targets. (See Table 13).

Preparation of Immunoglobulin Peptide Conjugate 3 by Redox Method.

The concentration of anti-DNP E273C IgG (107 mg, 0.73 μmol, 7.6 mL of a 14.06 mg/mL solution in A52Su buffer (10 mM sodium acetate, 9% (w/v) sucrose, pH 5.2)) was measured by UV absorbance (Nanodrop 1000 spectrophotometer, Thermo Scientific, 280 nM wavelength, extinction coefficient of 1.37) and diluted into reaction buffer (32.5 mL of 50 mM sodium phosphate, 2 mM EDTA, pH 7.5) in a sterile 50 mL centrifuge tube. Reduction was accomplished by adding 3 equivalents of TCEP per engineered cysteine (4.36 μmol, 1.1 mL of 4.0 mM solution in sterile water) to the IgG solution and incubating for 1 h at room temperature without stirring. Zeba desalting spin cartridges (10 mL, Thermo Scientific product#87772, 40K MWCO) were prepared for use by centrifuging once at 1000×g for 2 min to remove the storage solution, then washing twice with 5 mL of reaction buffer and centrifuging at 1000×g for 2 min each time, and finally washing with 5 mL of reaction buffer and centrifuging at 1000×g for 6 min. The reaction mixture was exchanged into reaction buffer using 10 desalt columns by adding 4 mL of solution to each previously prepared desalt column and centrifuging at 1000×g for 4 minutes to collect the samples, which were re-combined in a single sterile 50 mL centrifuge tube. To the solution of reduced IgG in reaction buffer was added a freshly prepared solution of dehydroascorbic acid (4.5 equivalents per engineered cysteine, 6.5 μmol, 1.6 mL of 4.0 mM solution in reaction buffer, Aldrich product#261556), and the reaction mixture was incubated for 15 min at room temperature. To the solution of re-oxidized IgG was added a solution of CyA-[Nle6,Atz(PEG11-bromoacetamide)17,Glu28]JzTx-V(1-29) (SEQ ID NO:888) (3 equivalents per engineered cysteine, 4.36 μmol, 1.7 mL of 2.5 mM solution in sterile water) to give a final volume of 42.9 mL (2.5 mg/mL IgG concentration). The reaction solution was incubated at room temperature for 18 h without stirring. Zeba desalting spin cartridges (10 mL, Thermo Scientific product#87772, 40K MWCO) were prepared for use by centrifuging once at 1000×g for 2 min to remove the storage solution, then washing twice with 5 mL of A52Su buffer (freshly filtered through a 0.22 μm filter) and centrifuging at 1000×g for 2 min each time, and finally washing with 5 mL of A52Su buffer and centrifuging at 1000×g for 6 min. The reaction mixture was exchanged into A52Su buffer using 11 desalt columns by adding 4 mL of solution to each desalt column and centrifuging at 1000×g for 4 minutes to collect the samples. The combined sample mixture was concentrated to 10 mL (~10 mg/mL protein concentration) by centrifugal filtration by added equal volumes to 4 centrifugal concentrators (Amicon 15, 10 K, Millipore) and centrifuging at 4000×g for 15 min. The concentrated samples were recombined and purified by strong cation ion exchange chromatography on an Agilent 1200 HPLC using a 5 mL HiTrap SP HP column (GE Healthcare, 17-1152-01) and eluting with a 0-20% B over 5 min, 20-50% B over 30 min, 100% B flush for 5 min, and 0% B re-equilibration for 10 min gradient (A buffer: 100 mM sodium acetate, pH 5.0 and B buffer: 100 mM sodium acetate, 1.2 M NaCl, pH 5.0) at a 5 mL/min flow rate with fraction collection by UV absorbance threshold (280 nM wavelength). Fractions containing the desired product were combined and dialyzed into A52Su buffer (250 mL Slide-A-Lyzer dialysis flask, 20K MWCO, Thermo Scientific product #87763, 3×3 L of A52Su buffer for 12 h, 4 h, and 3 h). The product mixture was concentrated to 6 mL by centrifugal filtration by added equal volumes to 4 centrifugal concentrators (Amicon 15, 10 K, Millipore) and centrifuging at 4000×g. The product mixture was sterilized by syringe filtration (MILLEX GP, 0.22 μM, Millipore). The concentration was determined by UV absorbance (10.49 mg/mL in 6.5 mL, 68.8 mg (60.5% yield), aliquots of the product were removed for analysis by SEC, HIC, LC/MS-TOF, endotoxin analysis, and SDS-PAGE gel electrophoresis as described below, and the product was frozen at −80° C. Analytical size exclusion chromatography (SEC) was performed on an Agilent 1260 Bioinert HPLC using a QC-PAK GFC 300 column (Tosoh Biosciences, 7.8 mm×15 cm, 5 μM) and eluting for 15 min with an isocratic method of 100% B buffer (0.17 M potassium phosphate monobasic, 0.21 M KCl, 15% (v/v) IPA, pH 7.0) at a 0.5 mL/min flow rate. SEC analysis (10 ug injection) revealed 96.9% monomer with 3.1% of higher molecular weight species (UV absorbance, 280 nM). (See, FIG. 165). Analytical hydrophobic interaction chromatography (HIC) was performed on an Agilent 1100 HPLC using a ProPac HIC-10 column (Dionex, 5 μM, 300 A, 4.6×100 mm) with a 0-100% B in 10 min with a 2 min flush and 3 min equilibration (A buffer: 20 mM sodium acetate, 1 M ammonium sulfate, pH 5 and B buffer: 20 mM sodium acetate, 10% acetonitrile, pH 5) at a 1.0 mL/min flow rate. HIC analysis (10 ug injection in 20 uL of A buffer) revealed 99% main peak (UV absorbance, 280 nM). Three samples were prepared for analysis. A 10 ug aliquot of the product was diluted to 25 uL with DPBS in a polypropylene LC sample vial, and 2 uL was injected into the LC/MS-TOF for the intact, non-deglycosylated sample. A 30 ug aliquot of the product was added to a 96 well polypropylene plate and diluted up to 24 uL with reaction buffer. PNGase F (2 uL, 5 U/mL, QA Bio) was added, and the solution was incubated at 37° C. for 18 h on a Torrey Pines heater/shaker (300 rpm). A 12 uL aliquot of the deglycosylated sample was removed for full TCEP reduction (vide infra). The remaining material was diluted with DPBS (12 uL) and LC/MS-TOF data was obtained from a 2 uL injection. An aliquot of the TCEP solution described above (12 uL) was added to the previously removed aliquot (12 uL) of the deglycosylated product. The solution was shaken in a Torrey Pines heater/shaker at 37° C. for 45 min (300 rpm), and the reduced, deglycosylated sample was analyzed by LC/MS-TOF. LC/MS-TOF analysis was performed on an Agilent 1290 HPLC with an Agilent 6224 TOF LC/MS using a PLRP-S column (1000 A, 5 μM, 2.1×50 mm, product# PL1912-1502) eluted with a 10-50% B over 10 min gradient (A buffer: water with 0.1% formic acid and B buffer: acetonitrile with 0.1% formic acid) at a flow rate of 0.8 mL/min. (See, FIG. 166A-C). Samples for SDS-PAGE gel electrophoresis were prepared in an Eppendorf tube (1.5 mL) by mixing product (0.5 uL of 10 mg/mL) with Novex tris-glycine SDS sample buffer (2×) (13 uL, Cat# LC2676), Nupage sample reducing agent (10X) (Cat# NP0004, Lot#1213695, 3 uL for reduced sample only) and DI water (9 uL for reduced sample and 12 uL for non-reduced sample). The mixtures were heated at 75° C. for 10 minutes, cooled, and 10 uL was added to the gel with MW standard SeeBlue plus2 (Cat# LC5925, Lot#1143316). The sample was developed for 1 h using an Invitrogen Powerease 500 (200V, 89 mA, 10 W). The gel was removed and stained with Coomassie Blue for 1 h, then washed with deionized water for 4 h, and imaged. (See, FIG. 167). For endotoxin analysis, a 25 ug aliquot of product was diluted to 125 uL at a 0.2 mg/mL using endotoxin-specific buffer (product code BG120, Lot# TFM5040) and tested on the Endosafe-MCS (Charles River) using the manufacturer's instructions. The endotoxin level was <0.25 EU/mg.

Example 10: Use of Multivalent Linkers to Prepare Toxin Peptide Analog Dimers To increase the inventive toxin peptide analog's in vivo half-life, alter its distribution profile, and thus increase its in vivo Nav1.7 target coverage, we prepared IgG- and Fc-conjugates of Nav1.7 inhibitory peptides. (See, Murray et al., Potent and selective inhibitors of Nav1.3 and Nav1.7, WO 2012/125973 A2). However, the modest potency of these first peptide conjugates limited in vivo plasma concentrations to ~1× the in vitro Nav1.7 IC50, a level of target coverage which was not been sufficient to achieve efficacy (data not shown).

Figure 73:
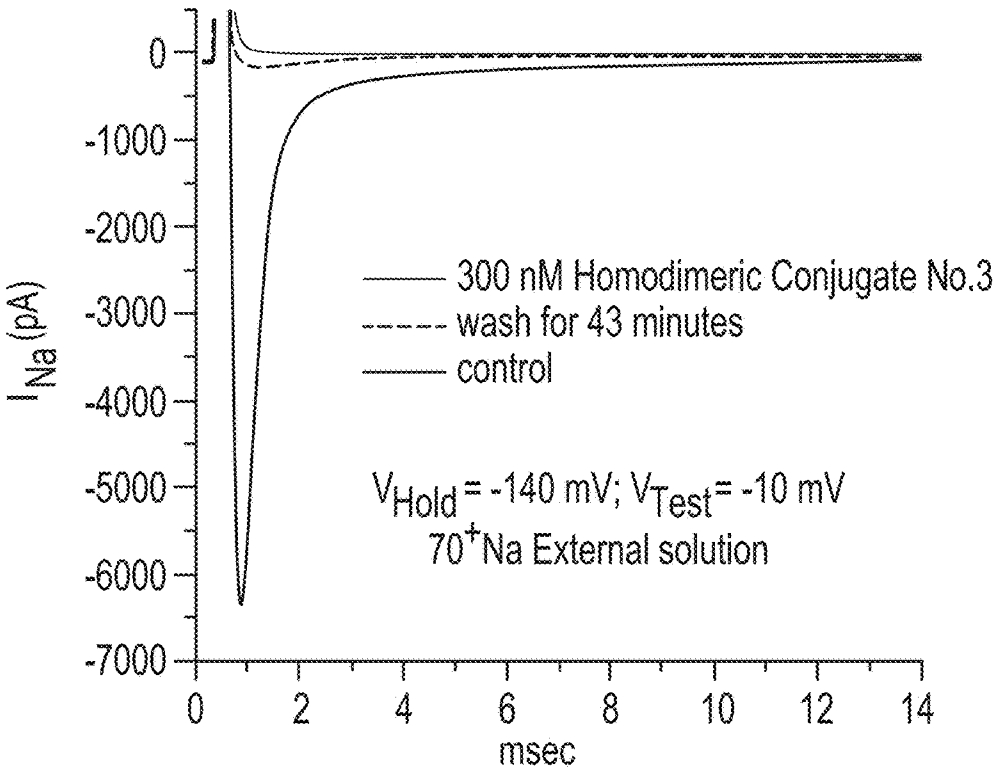
FIG. 73 shows representative block of Nav1.7 current with administration of 300 nM concentration of dimeric peptide Homodimeric Conjugate No. 3 by manual electrophysiology (Nav1.7 WCPC $IC_{50}$=0.00058 μM).
Figure 74:
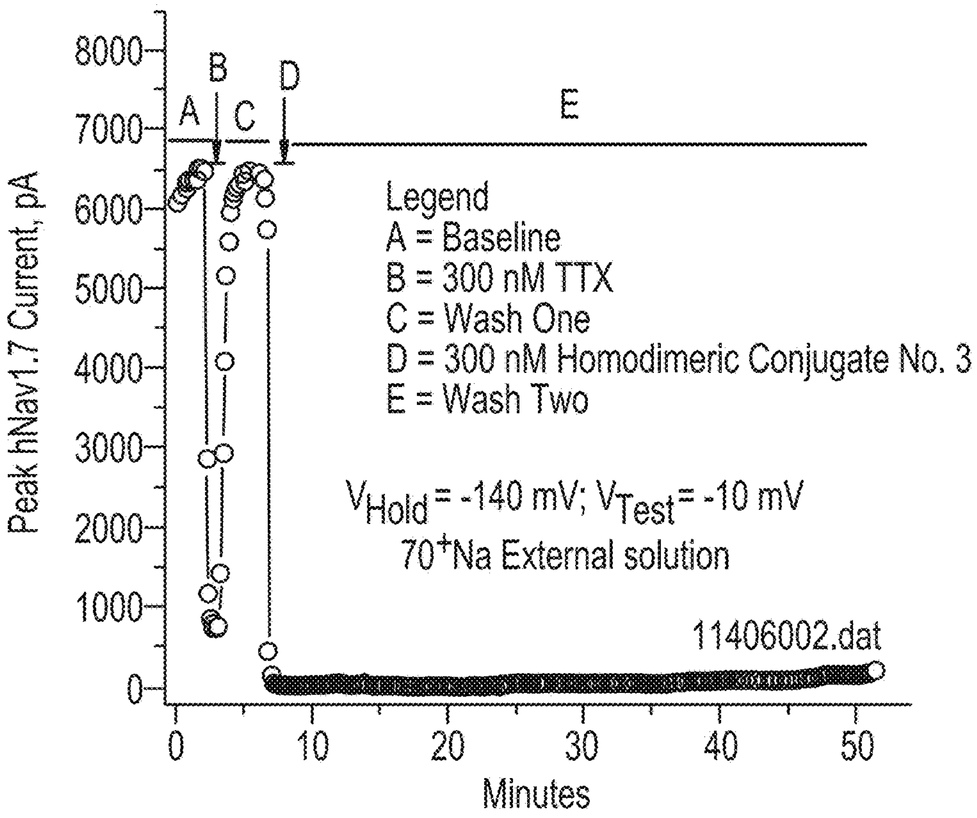
FIG. 74 shows a representative time course of block of Nav1.7 current by addition of 300 nM concentration of dimeric peptide Homodimeric Conjugate No. 3 by manual electrophysiology (WCPC). There was no washout of peptide and no recovery of current even after 45 minutes.

In a parallel effort, dimerization was explored as a strategy to improve the potency of the Nav1.7 inhibitory peptides. Two peptide dimers with different linker lengths, 2000 and 500 Da polyethyleneglycol (PEG), were prepared and tested in the Nav1.7 PATCHXPRESS® patch clamp system electrophysiology assays (Homodimeric Peptide No. 3 and Homodimeric Peptide No. 4). Although the $IC_{50}$ values of the two compounds were quite similar, the dimer with the longer linker was extremely slow to wash off of the target, if it ever did at all (see FIGS. 73-74). In Table 22 below, PEGylated versions of [Phe6,Atz13]GpTx-1(1-34) (DCLGFFRKCIPD[Atz]DKCCRPNLVCSRTHKWCKYVF-NH2; SEQ ID NO:591) and [Ala5,Phe6,Atz13,Leu26,Arg28]GpTx-1 34 (DCLGAFRKCIPD[Atz]DKCCRPNLNCSRLHRWCKYVF-NH2; SEQ ID NO:592) were used for comparison. This slower off-rate can be a very beneficial property for the inhibition of the target in vivo and demonstrates the importance of optimizing the linker length. These linkers were polydisperse bis-azido PEGs, and one alkyne-containing peptide was attached to each end via a copper-catalyzed 1,3-dipolar cycloaddition reaction to form a triazole (see, FIGS. 75A-B and FIGS. 76A-B). However, these linkers did not contain an orthogonal chemical handle for conjugation of the peptide dimer to a protein.

Multivalent linkers with various monodisperse PEG lengths (n=3, 7, 11, 23, 35) that incorporate a haloacetamide (Br or I) functionality for reaction with the side chain thiol of an engineered cysteine within an Fc or IgG to form a stable thioether/thioacetamide linker were designed and prepared (see, FIGS. 78A-B and FIG. 80A-B). A series of monovalent and divalent peptides and a conjugate have been prepared from the potent Nav1.7 inhibitory peptide Pra-[Nle6]JzTx-V (SEQ ID NO:425). We modified Pra-[Nle6] JzTx-V (SEQ ID NO:425) with a PEG11 linker (Atz (PEG11-benzylthioacetamide)-[Nle6]JzTx-V(1-29); SEQ ID NO: 427) and prepared the dimer of Pra-[Nle6]JzTx-V (SEQ ID NO:425) with a multivalent linker (Homodimeric Conjugate No. 1 and Homodimeric Conjugate No. 2, see Example 5), and the Anti-DNP mAb (E273C, hIgG1; SEQ ID NO:542; SEQ ID NO:543; SEQ ID NO:542; SEQ ID NO:543) conjugate of the dimeric peptide (i.e, Bis-{Atz (PEG23*)-[Nle6]JzTx-V(1-29)}-5-((2-bromoacetamido) methyl)isophthalamide, see Example 5) to yield Immunoglobulin Peptide Conjugate 1 (see, Table 21). (Table 13 and FIG. 81A-C). These constructs showed an increase in potency upon dimerization, and the conjugate of the dimer shows a 10-fold increase in potency relative to the previous IgG-peptide conjugate. The linker structure in FIG. 78A-B demonstrated great utility for the preparation of multivalent conjugates comprising the inventive toxin peptide analogs. Additional dimeric peptide linkers were prepared to vary the attachment site of the linker within the peptide and the Nav1.4 selectivity of the peptide scaffold. Analogs were prepared with an amine functionality for assay and with the bromoacetamide functionality for conjugation. (See, Table 22).

TABLE 22

Nav1.7 PX analysis of Homodimeric JzTx-V and GpTx-1 peptide analogs.

| Designation (see, Example 5) | Peptide | SEQ ID NO: | Linker | Nav1.7 PX IC50 (μM) | Wash out |
|---|---|---|---|---|---|
| Homodimeric Peptide No. 1 | Atz-[Nle6]JzTx-V(1-29) | 572 | Bis-PEG23-bromoacetamide | | |
| Homodimeric Peptide No. 2 | Atz-[Nle6]JzTx-V(1-29) | 572 | Bis-PEG23-benzylthioacetamide | 0.000241 | No |
| Homodimeric Peptide No. 3 | [Phe6,Atz13]GpTx-1(1-34) | 591 | 2000 Da PEG | 0.013 | No |
| Homodimeric Peptide No. 4 | [Phe6,Atz13]GpTx-1(1-34) | 591 | 500 Da PEG | 0.019 | Yes |
| Homodimeric Peptide No. 5 | [Ala5,Phe6,Atz13,Leu26,Arg28]GpTx-1(1-34) | 592 | 2000 Da PEG | 0.091 | Yes |
| Homodimeric Peptide No. 6 | Atz-[Nle6]JzTx-V(1-29) | 572 | Bis-PEG23-amine | 0.000414 | No |
| Homodimeric Peptide No. 7 | Atz-[Nle6,Glu28]JzTx-V(1-29) | 885 | Bis-PEG23-amine | 0.002121 | No |
| Homodimeric Peptide No. 8 | CyA-[Nle6,Atz17,Glu28]JzTx-V(1-29) | 889 | Bis-PEG23-amine | 0.000679 | No |
| Homodimeric Peptide No. 9 | CyA-[Nle6,Lys(Atz)14,Glu28]JzTx-V(1-29) | 892 | Bis-PEG23-amine | 0.001319 | No |
| Homodimeric Peptide No. 11 | Atz-[Nle6,Glu28]JzTx-V(1-29) | 885 | Bis-PEG23-bromoacetamide | | |
| Homodimeric Peptide No. 12 | CyA-[Nle6,Atz17,Glu28]JzTx-V(1-29) | 889 | Bis-PEG23-bromoacetamide | | |
| Homodimeric Peptide No. 13 | CyA-[Nle6,Lys(Atz)14,Glu28]JzTx-V(1-29) | 892 | Bis-PEG23-bromoacetamide | | |

Experimental Methods.

The following series of reactions ((III)-(XI)) was conducted.

1.

(III)

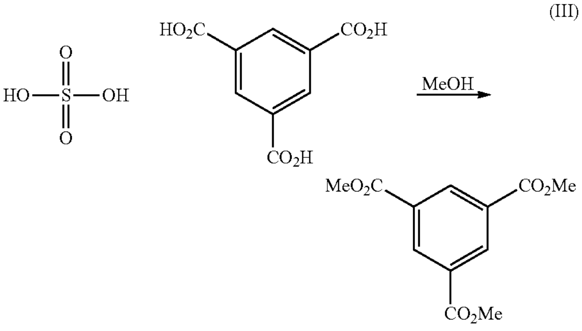

Benzene-1,3,5-tricarboxylic acid (50 g, 238 mmol) was dissolved in MeOH, and then conc. sulfuric acid (12.68 mL, 238 mmol) was slowly added. The solution became clear after 30 minutes of reflux and was left stirring at 72° C. for overnight. Solvent was removed under reduced pressure, the residue was dissolved in chloroform (2×800 mL) and washed with NaHCO3, then the organic solvent was removed in vacuo. (60 g, 100% yield).

2.

(IV)

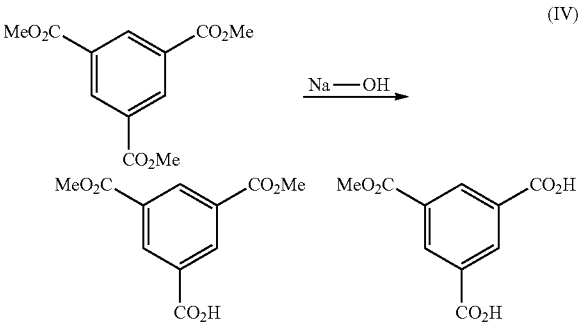

Molecular Weight: 238.19

Molecular Weight: 224.17

The trimethyl benzene-1,3,5-tricarboxylate (62 g, 246 mmol) was dissolved in MeOH (800 mL), aq. sodium hydroxide (221 mL, 221 mmol)-(1N) was slowly added. The suspension was stirred vigorously and slowly dissolved during 8 hours. The reaction was left stirred at room temperature for 18 hours, then the solvent was removed in vacuo.

DCM (600 mL) was added to the solid and the organic phase was washed with sat. $NaHCO_3$ (3x500 mL) ~3 layers in the separation funnel—solution was filtered and solid on the funnel was rinsed with DCM. The LC-MS of the crude confirmed that MW was of the desired product (MW: 238; 48.8 g; yield 83%). The LC-MS analysis of material from the organic layer showed a mixture of the desired product as well as over-hydrolyzed product (MW: 224; 9 g), and analysis of material from the aqueous layer showed start material.

3.

(V)

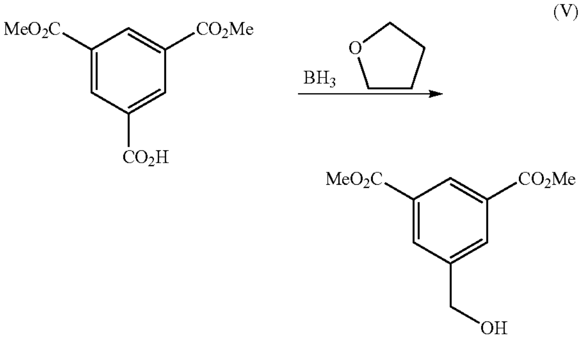

3,5-bis(methoxycarbonyl)benzoic acid (10 g, 42.0 mmol) was dissolved in dry THF (80 mL). The flask was placed in ice-bath and bh3.thf (84 mL, 84 mmol) was added slowly (some bubbling occurred). The reaction mixture was left stirring at room temperature for 24 hours. After 14 hours reaction did not progress, another 3 eq. of bh3.thf (42.0 mL, 42.0 mmol) were slowly added and the reaction mixture was stirred at room temperature for hours. The reaction was completed (~95% by LC-MS).

The reaction mixture was quenched with MeOH (added slowly ~80 mL) and left stirred for 1 hour at RT. The solvent was removed in vacuo. The product was re-dissolved in EtOAc (white solution ~1000 mL) and the organic layer was washed with water (2x800 mL), sat. $NaHCO_3$ (800 mL) and brine (800 mL). The EtOAc was dried with $MgSO_4$, filtered and concentrated in vacuo (3.62 g; yield 38.5%).

4.

(VI)

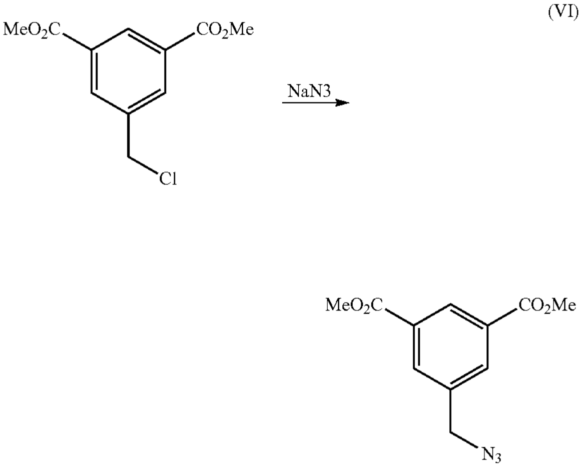

The dimethyl 5-(chloromethyl)isophthalate (5.69 g, 23.45 mmol) was dissolved in acetone (90 mL) and water (30 mL). Sodium azide (9.15 g, 141 mmol) was added as a last reagent and the solution was refluxed for 14 hours. After 14 hours the reaction was completed by LC-MS monitoring.

The reaction mixture was cooled down to room temperature and then concentrated in vacuo, the residue was re-dissolved in $CHCl_3$ (250 mL) and the organic layer was washed with water (3x200 mL) and brine (200 mL). The organic layer was then dried over $MgSO_4$, filtered and concentrated in vacuo (5.34 g; yield 91%).

5.

(VII)

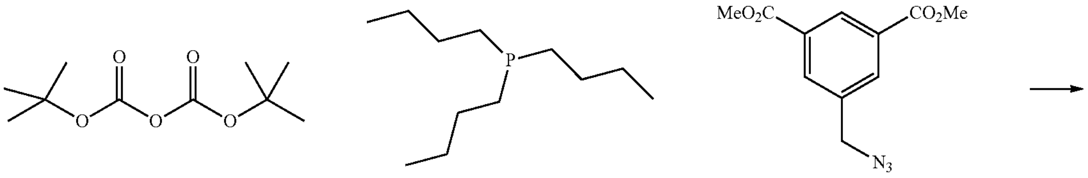

-continued

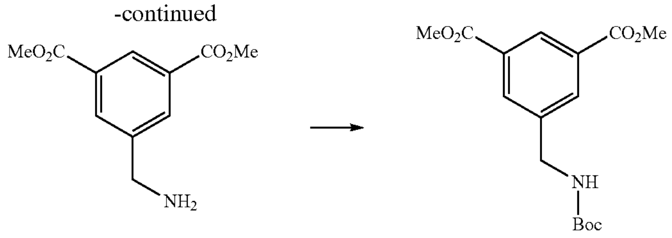

The dimethyl 5-(azidomethyl)isophthalate (1.5 g, 6.02 mmol) was dissolved in 40 mL of diethyl ether (40 mL). Tri-n-butylphosphine (1.654 mL, 6.62 mmol) was added slowly and the reaction mixture was stirred for 45 minutes at room temperature and then frozen to −50° C. The solution of di-tert-butyl dicarbonate (1.417 mL, 6.62 mmol) in ether (20 mL) was slowly added (~10 min) and the reaction mixture was stirred at −50° C. for 1 hour and then quenched with saturated $NaHCO_3$ (20 mL). The reaction mixture was then extracted with ether. Organic phase was dried with $MgSO_4$, filtered and concentrated in vacuo. Sample was dissolved in a mixture of DCM and MeOH, sillica gel was added, and it was concentrated in vacuo until dry. Automated normal phase purification was performed: 0-30 min. 0-30% of EtOAc in Hexanes. All fractions were collected and analyzed by LC-MS and TLC to identify desired product; concentrated in vacuo, used directly in the next step of the synthesis (760 mg; yield 75%).

6.

(VIII)

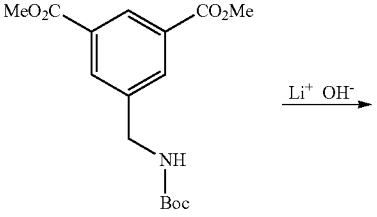

-continued

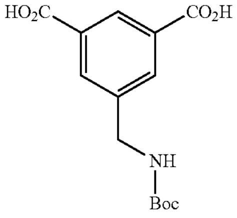

A solution of dimethyl 5-(((tert-butoxycarbonyl)amino) methyl)isophthalate (830 mg, 2.57 mmol) in MeOH (40 ml) was treated with lithium hydroxide (984 mg, 41.1 mmol) previously dissolved with water (20 mL). The reaction mixture was stirred at 45° C. for 6 hours. After 6 hours the starting material was completely consumed. MeOH from the reaction solution was evaporated in vacuo and the aqueous layer was extracted with ether (50 mL). The aqueous layer was then acidified with an aqueous solution of HCl (2M) at 0° C. until pH 3-4 was reached and precipitation of the desired product occurred. Sample was filtered through a paper filter and washed twice with ether (10 mL). Sample was dried in air. (570 mg; yield 75%).

7.

(IX)

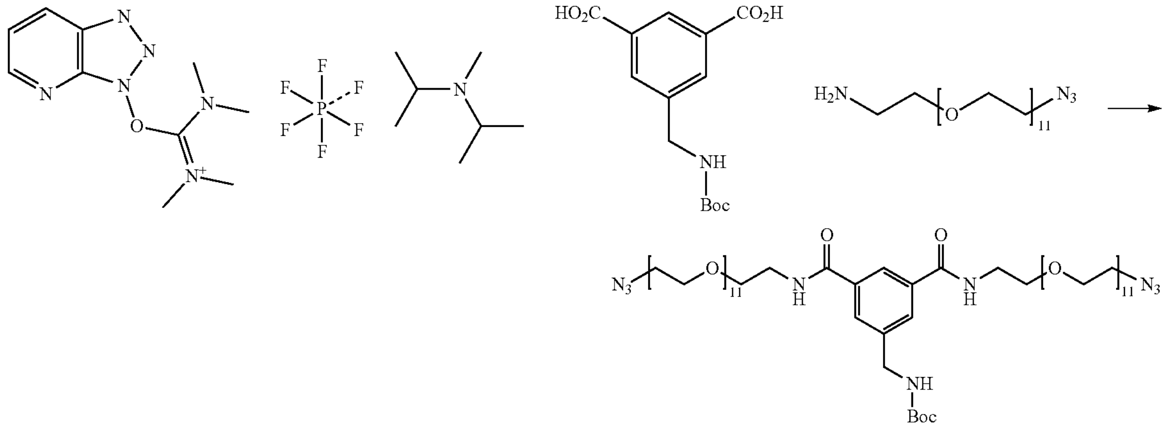

To a solution of 5-(((tert-butoxycarbonyl)amino)methyl) isophthalic acid (59.1 mg, 0.200 mmol) in dimethylformamide (DMF), 2-(7-Aza-1H-benzotriazole-1-yl)-1,1,3,3-tetramethyluronium hexafluorophosphate (HATU, 168 mg, 0.441 mmol) was added, the reaction mixture was stirred for 10 min. at room temperature, followed by Azido-dPEG11-amine (400 mg, 0.701 mmol) addition (20 minutes stirring) and N-ethyl-N-isopropylpropan-2-amine (0.116 ml, 0.701 mmol) addition. The reaction mixture was left at room temperature with stirring. The reaction was monitored on LC-MS, after 14 hours desired product was observed, nearly 95% by LC-MS. Sample was taken to purification directly: Gilson, Prep HPLC, 10 min. run time; 10-90% acetonitrile (ACN) in water, collect all, 254 nm); fractions were collected and concentrated in GeneVac overnight at 30° C. (158 mg; yield 56%).

8.

(X)

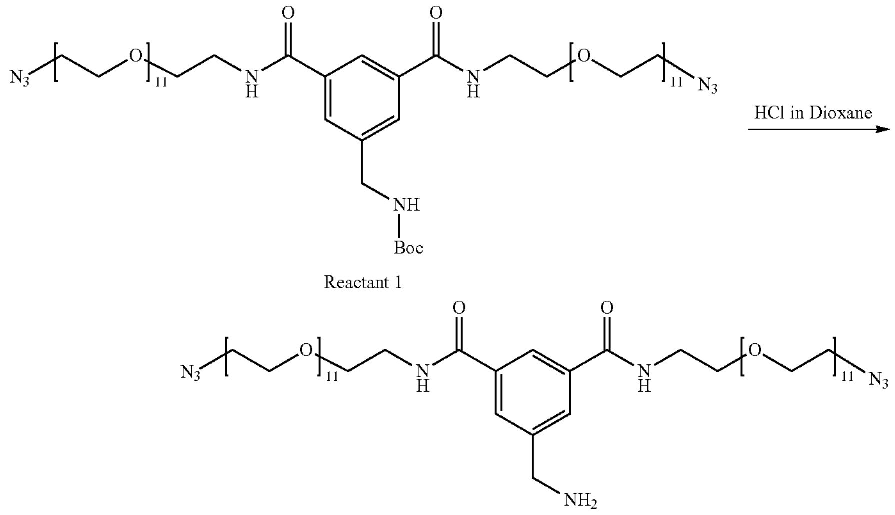

To Reactant 1 (192.4 mg, 0.137 mmol) HCl in 1,4 Dioxane (3 mL) was added; the reaction mixture was stirred for 60 min. at room temperature. Sample was monitored on LC-MS and after 1 hour desired product was observed, nearly 98% by LC-MS. Sample was concentrated in vacuo and purified on Prep HPLC, 15 min. 10-90% ACN in water; 254 nm). Fractions were collected and dried in Genevac for 18 hours at 30° C. (127 mg; yield 71%).

9.

(XI)

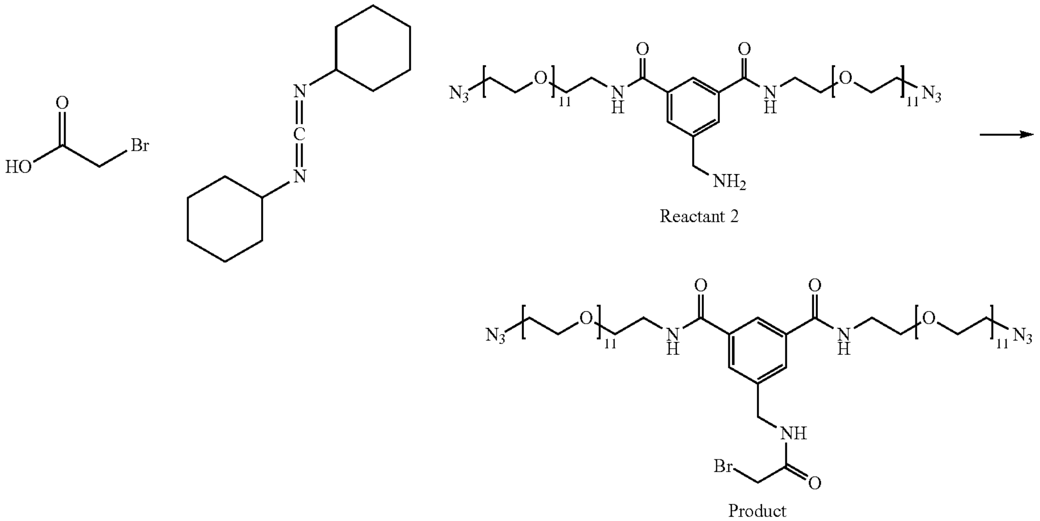

To a solution of Reactant 2 (50 mg, 0.038 mmol) and dicyclohexylcarbodiimde (23.80 mg, 0.115 mmol) in dichloromethane was added bromoacetic acid (21.37 mg, 0.154 mmol). The reaction mixture was stirred for 2.5 hours, and sample mixture was concentrated in vacuo then redisolved in DMF/MeOH mixture (50:50 v/v). White material crushed out and it was filtered via 0.45 μm filter. The clear solution was injected directly to Prep HPLC Gilson (10-90% ACN in water in 10 min., collect all, 254 nm). The fractions were dried in GeneVac for 18 hours at 40° C., and the fractions were characterized by H-NMR and LC-MS (12.6 mg; yield 23%).

A similar reaction scheme ((XII)-(XIV)) was employed with Azido-dPEG23-amine instead of Azido-dPEG11-amine to provide the divalent bifunctional linker that was used to prepare Homodimeric Conjugate No. 1 (see, Example 5) and then Immunoglobulin Peptide Conjugate 1 (see, Example 9).

11.

(XIII)

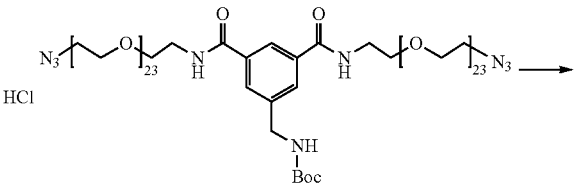

Reactant 1

10.

(XII)

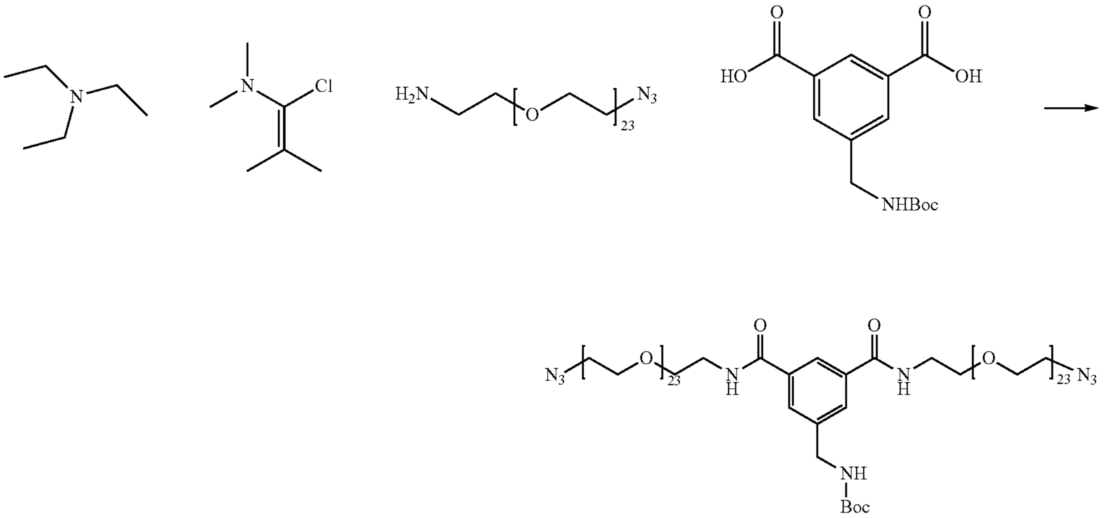

A suspension of 5-(((tert-butoxycarbonyl)amino)methyl) isophthalic acid (150 mg, 0.508 mmol) in DCM (5 mL) was treated with 1-chloro-N,N,2-trimethylprop-1-en-1-amine (Aldrich, 0.155 mL, 1.168 mmol). The reaction was stirred at 23° C. under nitrogen. After 1 h 15 min, the reaction was concentrated and dried under vacuum. The crude acid chloride was dissolved in DCM (5 mL), and treated with azido-PEG23-amine (Quanta BioDesign, 1675 mg, 1.524 mmol) and triethylamine (0.354 mL, 2.54 mmol) was then added in dropwise fashion. The reaction was stirred under nitrogen at 23° C., and subsequently concentrated after 4 h and dried under vacuum. The crude mixture was dissolved in 30% MeCN/water (3 mL) and filtered through a Whatman 0.45 μm filter, and purified on HPLC using a Phenomenex Synergi 4 μm MAX-RP 80 Å 250×30 mm column and a gradient: 10-55% MeCN/water+0.1% TFA in 35 min @ 30 ml/min flow rate (5 runs of 1.5 mL each). The pooled fractions were frozen and lyophilized over 60 h to afford a colorless semi-solid that was characterized by H-NMR and LCMS (675 mg; yield 54%).

-continued

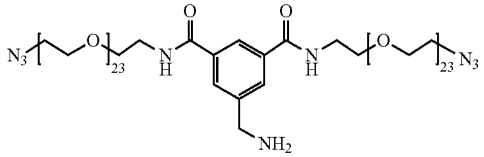

(XIII)

A solution of Reactant 1 (0.675 g, 0.275 mmol) in hydrogen chloride, 4.0 m solution in 1,4-dioxane (10.30 ml, 41.2 mmol) was stirred at 23° C. After 19 h, the reaction mixture was concentrated and dried under vacuum affording a white solid. It was dissolved in 5 ml water and converted to a free base using VariPure IPE® carbonate resin. The resin (~400 mg) was conditioned in a column with methanol (6 mL), followed by water (6 mL). The product HCL salt in water was applied and the flow through was collected. The column was washed with water (3×6 mL) and the filtrates were combined with the initial flow through and frozen. The solid was lyophilized to a white fluffy solid (580 mg; yield 90%).

12.

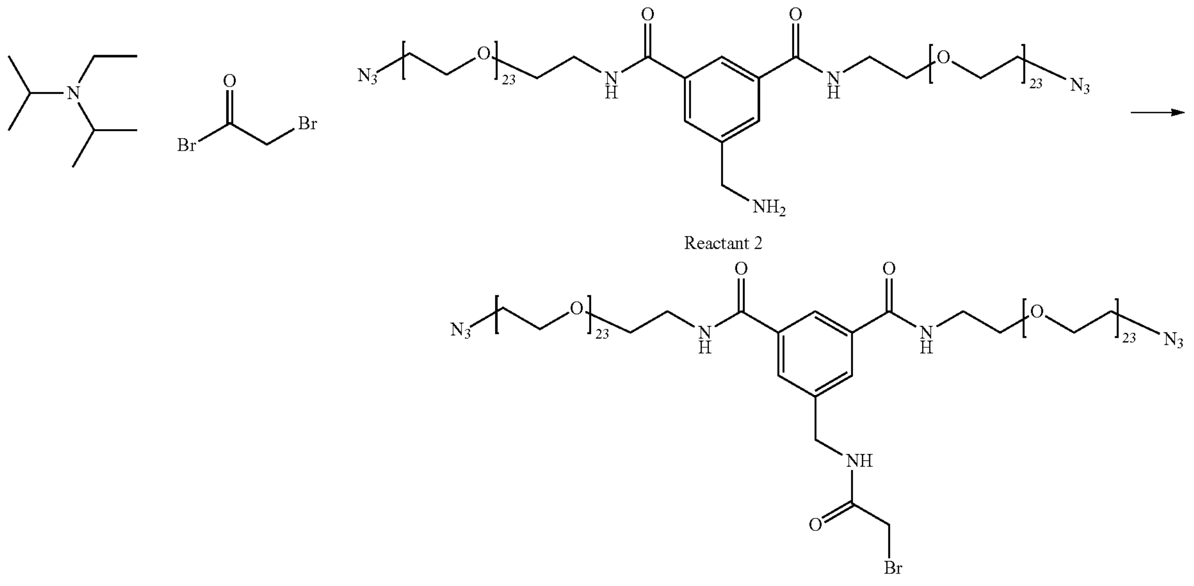

Reactant 2

Product (XIV)

A solution of Reactant 2 (580 mg, 0.246 mmol) in DCM (5 mL) was cooled to 0° C. under nitrogen and was treated with n,n-diisopropylethylamine (0.107 mL, 0.615 mmol), followed by bromacetyl bromide (0.027 mL, 0.307 mmol). The reaction was stirred at 0° C. LCMS at 20 min showed complete reaction to product. The solvent was removed under reduced pressure and the reaction was dried under vacuum. The crude mixture was dissolved in 30% MeCN/water (8 mL) and filtered through a Whatman 0.45 μm filter, and purified via HPLC using a Phenomenex Synergi 4 μm MAX-RP 80 Å 250×30 mm column and a gradient: 10-55% MeCN/water+0.1% TFA in 35 min @ 30 ml/min flow rate (4 runs of 2 mL each). The pooled fractions were frozen and lyophilized over the weekend to afford a light brown semi-solid characterized by H-NMR and LC-MS (355 mg; yield 58%).

Example 11: Site Specific Peptide Conjugation to Human Serum Albumin

The following protocol was used to site-specifically conjugate toxin peptide analogs (see, Table 5 for toxin peptide analog amino acid sequences and Table 22 for homodimeric toxin peptide analogs) to a human serum albumin (HSA) at the free sulfhydryl of a cysteine residue (C34 of SEQ ID NO:594). Peptide-linker constructs were prepared as described in Example 9 (monomeric) and Example 10 (dimeric).

The amino acid sequence of the human serum albumin that was used was the following (C34 linkage site is italicized and underlined):

SEQ ID NO.: 594

```
DAHKSEVAHRFKDLGEENFKALVLIAFAQYLQQCPFEDHVKLVNEVT

EFAKTCVADESAENCDKSLHTLFGDKLCTVATLRETYGEMADCCAKQ

EPERNECFLQHKDDNPNLPRLVRPEVDVMCTAFHDNEETFLKKYLYE
```

-continued

```
IARRHPYFYAPELLFFAKRYKAAFTECCQAADKAACLLPKLDELRDE

GKASSAKQRLKCASLQKFGERAFKAWAVARLSQRFPKAEFAEVSKLV

TDLTKVHTECCHGDLLECADDRADLAKYICENQDSISSKLKECCEKP

LLEKSHCIAEVENDEMPADLPSLAADFVESKDVCKNYAEAKDVFLGM

FLYEYARRHPDYSVVLLLRLAKTYETTLEKCCAAADPHECYAKVFDE

FKPLVEEPQNLIKQNCELFEQLGEYKFQNALLVRYTKKVPQVSTPTL

VEVSRNLGKVGSKCCKHPEAKRMPCAEDYLSVVLNQLCVLHEKTPVS

DRVTKCCTESLVNRRPCFSALEVDETYVPKEFNAETFTFHADICTLS

EKERQIKKQTALVELVKHKPKATKEQLKAVMDDFAAFVEKCCKADDK

ETCFAEEGKKLVAASQAALGL//.
```

Preparation of Human Serum Albumin Peptide Conjugates.

Human serum albumin (HSA, SEQ ID NO:594; 100 uL of 10% w/v, 10 mg, 149 μmol, AlbIX, Novozymes Biopharma) was diluted into reaction buffer (3.8 mL of 50 mM sodium phosphate, 60 mM sodium caprylate, 2 mM EDTA, pH 7.5) in a sterile 15 mL centrifuge tube. To the solution of HSA was added a solution of CyA-[Nle6,Atz(PEG11-bromoacetamide)17,Glu28]JzTx-V(1-29) (SEQ ID NO:888) (3 equivalents, 450 μmol, 90 uL of 5.0 mM solution in sterile water) to give a final volume of 4 mL (2.5 mg/mL HSA concentration). The reaction solution was incubated at 37° C. for 18 h without stirring. A Zeba desalting spin cartridge (10 mL, Thermo Scientific product#87772, 40K MWCO) was prepared for use by centrifuging once at 1000×g for 2 min to remove the storage solution, then washing twice with 5 mL of HIC A buffer (20 mM sodium phosphate, 5 mM sodium caprylate, 1 M ammonium sulfate, pH 7.0) (freshly filtered through a 0.22 μm filter) and centrifuging at 1000×g for 2 min each time, and finally washing with 5 mL of HIC A buffer and centrifuging at 1000×g for 6 min. The reaction mixture was exchanged into HIC A buffer by adding the 4 mL of reaction mixture to the freshly prepared desalt column and centrifuging at 1000×g for 4 minutes to collect the exchanged sample. The sample mixture was concentrated to 2.5 mL by centrifugal filtration using a centrifugal concentrator (Amicon 4, 10K MWCO, Millipore) and centrifuging at 4000×g for 10 min. The concentrated sample was purified by hydrophobic interaction chromatography (HIC) on an Agilent 1200 HPLC using a 5 mL HiTrap Butyl HP column (GE Healthcare) and eluting with a 0-100% B over 50 min gradient (A buffer: 20 mM sodium phosphate, 5 mM sodium caprylate, 1 M ammonium sulfate, pH 7.0 and B buffer: 20 mM sodium phosphate, 5 mM sodium caprylate, pH 7.0) at a 5 mL/min flow rate with fraction collection by UV absorbance threshold (280 nM wavelength). Fractions containing the desired product were combined and concentrated to ~2 mL by centrifugal filtration using a centrifugal concentrator (Amicon 15, 10K MWCO, Millipore) and centrifuging at 4000×g. A Zeba desalting spin cartridge (5 mL, Thermo Scientific, 40K MWCO) was prepared for use by centrifuging once at 1000×g for 2 min to remove the storage solution, then washing twice with 2.5 mL of phosphate buffer (20 mM sodium phosphate, pH 7.0) and centrifuging at 1000×g for 2 min each time, and finally washing with 2.5 mL of phosphate buffer and centrifuging at 1000×g for 4 min. The reaction mixture was exchanged into phosphate buffer by adding the 2 mL of reaction mixture to the freshly prepared desalt column and centrifuging at 1000×g for 3 minutes to collect the exchanged sample. The product was further concentrated to ~0.5 mL by centrifugal filtration using a centrifugal concentrator (Amicon 4, 10K MWCO, Millipore) and centrifuging at 4000×g. The concentration was determined by UV absorbance (Nanodrop 1000 spectrophotometer, Thermo Scientific, 280 nM wavelength, extinction coefficient of 0.667) to be 11.8 mg/mL for 50 uL, 5.3 mg (51% yield), and aliquots of the product were removed for analysis by SEC, LC/MS-TOF, and SDS-PAGE gel electrophoresis as described below, and the product, HSA-Peptide Conjugate 1 (see, Table 23) was stored at 4° C.

Analytical size exclusion chromatography (SEC) was performed on an Agilent 1260 Bioinert HPLC using a QC-PAK GFC 300 column (Tosoh Biosciences, 7.8 mm×15 cm, 5 μM) and eluting for 15 min with an isocratic method of 100% B buffer (0.17 M potassium phosphate monobasic, 0.21 M KCl, 15% (v/v) IPA, pH 7.0) at a 0.5 mL/min flow rate. SEC analysis (10 ug injection) revealed 98.8% monomer with the remaining 1.2% being higher MW species (UV absorbance, 280 nM). (See, FIG. 168A-B). A 10 ug aliquot of the product was diluted to 25 uL with DPBS in a polypropylene LC sample vial, and 2 uL was injected into the LC/MS-TOF. LC/MS-TOF analysis was performed on an Agilent 1290 HPLC with an Agilent 6224 TOF LC/MS using a PLRP-S column (1000 A, 5 nm, 2.1×50 mm, product# PL1912-1502) eluted with a 10-50% B over 10 min gradient (A buffer: water with 0.1% formic acid and B buffer: acetonitrile with 0.1% formic acid) at a flow rate of 0.8 mL/min. (See, FIG. 169A-B). Samples for SDS-PAGE gel electrophoresis were prepared in an Eppendorf tube (1.5 mL) by mixing product (0.5 uL of 10 mg/mL) with Novex tris-glycine SDS sample buffer (2X) (13 uL, Cat# LC2676) and DI water (12 uL). The mixtures were heated at 75° C. for 10 minutes, cooled, and 10 uL was added to the gel with MW standard SeeBlue plus2 (Cat# LC5925, Lot#1143316). The sample was developed for 1 h using an Invitrogen Powerease 500 (200V, 89 mA, 10 W). The gel was removed and stained with Coomassie Blue for 1 h, then washed with deionized water for 4 h, and imaged. (See, FIG. 170).

An analogous protocol was employed using Homodimeric Peptide No. 12 to prepare HSA-Peptide Conjugate 2 (see, Table 23), which bears two copies of toxin peptide per HSA. Both HSA-peptide conjugates were tested in the hNav1.7 PX assay and found to have Nav1.7 inhibitory activity.

TABLE 23

Two human serum albumin (HSA)-JzTx-V peptide conjugates were made and tested in the hNav1.7 PX assay. (See Figure).

| Designation | SEQ ID NO of toxin peptide | Linker and residue position of linkage on toxin peptide | SEQ ID NOS of human serum albumin in conjugated molecule | Nav1.7 PX IC50 (μM) |
|---|---|---|---|---|
| HSA-Peptide Conjugate 1 | 889 | {PEG11-ethyl}-bromoacetamide at Atz17 | 594 | 2.618 |
| HSA-Peptide Conjugate 2 | 889 | Bis-{PEG23-ethyl}-5-((2-bromoacetamido)methyl)isophthalamide at Atz17 | 594 | 0.0729 |

Example 12: Action Potential Firing in Saphenous Nerve Skin Preparation

The following protocol was used to test the block of action potential firing by CyA-[Nle6,Pra17,Glu28]JzTx-V (1-29) (SEQ ID NO:395) in a saphenous nerve skin preparation. (See Lennertz R C, Kossyreva, E A, Smith A K, Stucky C L (2012) TRPA1 Mediates Mechanical Sensitization in Nociceptors during Inflammation. PLOS ONE 7 (8), 1-11). Male C57B1/6 mice (2-4 months old) were euthanized via cervical dislocation under $Na^+$-pentobarbital anesthesia (150 mg/kg; i.p.). Methods for isolating and recording from the saphenous nerve-skin preparation were modified from those previously described (Lennertz et al 2012). Briefly, the saphenous nerve and skin from the medial dorsum of the hindpaw were rapidly dissected, mounted in a custom made organ bath chamber with the corium side up, and bath superfused at speed 15 ml/min with 32° C. and oxygen-saturated synthetic interstitial fluid containing the following (in mM): 123 NaCl, 4 KCl, 0.7 $MgSO_4$, 1 $NaH_2PO_4$, 2.0 $CaCl_2$, 9.5 sodium gluconate, 10 glucose, 7.5 sucrose, and 10 HEPES, osmolarity 295 mOsm, pH 7.40 adjusted with NaOH. The proximal end of the saphenous nerve was passed through a hole into a separate, mineral-oil-filled recording chamber, desheathed, and teased into single fiber for extracellular recordings. Single fiber receptive fields in skin were detected by light pressure with a blunt glass rod. Fiber type was determined by action potential conductance velocity following receptive field electrical stimulation with square wave pulses (0.3-0.5 ms; 4-6 mA) delivered through a stainless steel microelectrode. Fibers with a conduction velocity less than 1.2 m/s were classified as C-fibers. Mechanical responses were evoked by square waves of 150 mN force using a mechanical stimulator (Dual-Mode Lever Systems, Aurora Scientific Inc., Canada). After a control period of 10 minutes, compound pre-warmed to 32° C. was applied to the receptive field in a stainless steel ring (inner diameter 5.25 mm and height 12 mm) and mechanical responses were evaluated every 5 minutes for 25 minutes (10 seconds per force application). Signals were recorded by a Neurolog system (Digitimer, UK) and Spike 2 software (Cambridge Electronic Design Ltd, UK) for off-line analysis. Action potentials were discriminated and counted using spike histogram software in Spike 2. All recordings and analysis were performed blinded to compound treatment.

The saphenous nerve skin preparation was used to evaluate the effect of CyA-[Nle6,Pra17,Glu28]JzTx-V(1-29) (SEQ ID NO:395) on mechanically-induced action potential firing from C-fibers in C57B1/6 mice. A concentration of 1.6 μM SEQ ID NO:395, equivalent to 100-fold the IC50 value in native TTX-S currents in DRG neurons, was applied to a small area of the skin using a small metallic cylinder and action potential firing following application of 150 mN force was evaluated every five minutes for 25 minutes. At the end of this time, 1 μM TTX was applied to block TTX-sensitive action potential firing. As shown in FIG. 171, 1.6 μM SEQ ID NO:395 blocked action potential firing by an average of over 60% whereas TTX completely blocked action potential firing. FIG. 172 illustrates that some C-fibers are fully blocked whereas other C-fibers are not or only weakly blocked by 1.6 μM SEQ ID NO:395. C-fibers that are poorly blocked or not blocked may be attributable to fibers being deeper in the skin and less accessible to SEQ ID NO:395 or to C-fibers that do not express Nav1.7 channels but other TTX-S sodium channels.

Abbreviations

Abbreviations used throughout this specification are as defined below, unless otherwise defined in specific circumstances.

5-C1W 5-Chlorotryptophan
5-BrW 5-Bromotryptophan
6-BrW 6-Bromotryptophan
6-MeW 6-Methyltryptophan
7-BrW 7-Bromotryptophan
2-BrhF 2-Bromohomophenylalanine
2-ClhF 2-Chlorohomophenylalanine
2-FhF 2-Fluorohomophenylalanine
2-MehF 2-Methylhomophenylalanine
2-MeOhF 2-Methoxyhomophenylalanine
3-BrhF 3-Bromohomophenylalanine
3-ClhF 3-Chlorohomophenylalanine
3-FhF 3-Fluorohomophenylalanine
3-MehF 3-Methylhomophenylalanine
3-MeOhF 3-Methoxyhomophenylalanine
4-BrhF 4-Bromohomophenylalanine
4-ClhF 4-Chlorohomophenylalanine
4-FhF 4-Fluorohomophenylalanine
4-Me-F 4-Methylphenylalanine
4-MehF 4-Methylhomophenylalanine
4-MeOhF 4-Methoxyhomophenylalanine
4tBu-F 4-tert-butyl-phenylalanine
Ac acetyl (used to refer to acetylated residues)

AcBpa acetylated p-benzoyl-L-phenylalanine
ACN acetonitrile
AcOH acetic acid
ADCC antibody-dependent cellular cytotoxicity
Aib aminoisobutyric acid
bA beta-alanine
BhPra bishomopropargylglycine
Bpa p-benzoyl-L-phenylalanine
BrAc bromoacetyl ($BrCH_2C(O)$)
BSA Bovine serum albumin
Bzl Benzyl
Cap Caproic acid
CBC complete blood count
Cha Cyclohexylalanine
CNS central nervous system
COPD Chronic obstructive pulmonary disease
CTL Cytotoxic T lymphocytes
DCC Dicylcohexylcarbodiimide
DCM dichloromethane
Dde 1-(4,4-dimethyl-2,6-dioxo-cyclohexylidene)ethyl
DMF dimethylformamide
DOPC 1,2-Dioleoyl-sn-Glycero-3-phosphocholine
DOPE 1,2-Dioleoyl-sn-Glycero-3-phosphoethanolamine
DPBS Dulbecco's phosphate-buffered saline
DPPC 1,2-Dipalmitoyl-sn-Glycero-3-phosphocholine
DRG dorsal root ganglion
DSPC 1,2-Distearoyl-sn-Glycero-3-phosphocholine
DTT Dithiothreitol
EAE experimental autoimmune encephalomyelitis
ECL enhanced chemiluminescence
EPA 4-ethynylphenylalanine
ESI-MS Electron spray ionization mass spectrometry
Et ethyl
FACS fluorescence-activated cell sorting
Fmoc fluorenylmethoxycarbonyl
H-NMR proton-nuclear magnetic resonance
HATU 2-(7-Aza-1H-benzotriazole-1-yl)-1,1,3,3-tetramethyluronium
hexafluorophosphate
HOBt 1-Hydroxybenzotriazole
HPLC high performance liquid chromatography
hPra homopropargylglycine
HSA human serum albumin
HSL homoserine lactone
IB inclusion bodies
IWQ IONWORKS® QUATTRO patch clamp system
KCa calcium-activated potassium channel (including IKCa, BKCa, SKCa)
KLH Keyhole Limpet Hemocyanin
Ky voltage-gated potassium channel
Lau Laurie acid
LPS lipopolysaccharide
LC-MS liquid chromatography-mass spectrometry
LYMPH lymphocytes
MALDI-MS Matrix-assisted laser desorption ionization mass spectrometry
Me methyl
MeO methoxy
MeOH methanol
MHC major histocompatibility complex
MMP matrix metalloproteinase
MW Molecular Weight
MWCO Molecular Weight Cut Off
1-Nap 1-napthylalanine
Nay, $Na_V$ voltage-gated sodium channel
NEUT neutrophils
Nle norleucine NMP N-methyl-2-pyrrolidinone
NMR Nuclear Magnetic Resonance
OAc acetate
PAGE polyacrylamide gel electrophoresis
PBMC peripheral blood mononuclear cell
PBS Phosphate-buffered saline
Pbf 2,2,4,6,7-pendamethyldihydrobenzofuran-5-sulfonyl
PCR polymerase chain reaction
PD pharmacodynamic
Pec pipecolic acid
PEG Poly(ethylene glycol)
Pic picolinic acid
PK pharmacokinetic
PNS peripheral nervous system
PX PATCHXPRESS® patch clamp system
pY phosphotyrosine
RBS ribosome binding site
RT room temperature (25° C.)
Sar sarcosine
SDS sodium dodecyl sulfate
STK serine-threonine kinases
t-Boc tert-Butoxycarbonyl
tBu tert-Butyl
TCEP tris(2-carboxyethyl)phosphine
TCR T cell receptor
TFA trifluoroacetic acid
TG trigeminal ganglion
THF thymic humoral factor
Trt trityl
TTX tetrodotoxin
WCPC whole cell patch clamp

---

SEQUENCE LISTING (1747 sequences)

SEQ ID NO: 1 - protein, 29 aa, Chilobrachys jingzhao
  source: /note="N-term Amino group"
  source: /note="C-term FreeAcid"
YCQKWMWTCDSKRACCEGLRCKLWCRKII

SEQ ID NO: 2 - protein, 29 aa, Chilobrachys jingzhao
  source: /note="N-term Amino group"
  source: /note="C-term Amide"
YCQKWMWTCDSKRACCEGLRCKLWCRKII

SEQ ID NO: 3 - protein, 29 aa, Artificial Sequence
  source: /note="Description of Artificial Sequence: Synthetic peptide"
  source: /note="N-term Amino group"
  source: /note="C-term Amide"
ACQKWMWTCDSKRACCEGLRCKLWCRKII

SEQ ID NO: 4 - protein, 29 aa, Artificial Sequence
  source: /note="Description of Artificial Sequence: Synthetic peptide"
  source: /note="N-term Amino group"
  source: /note="C-term Amide"
YCAKWMWTCDSKRACCEGLRCKLWCRKII

SEQ ID NO: 5 - protein, 29 aa, Artificial Sequence
  source: /note="Description of Artificial Sequence: Synthetic peptide"
  source: /note="N-term Amino group"
  source: /note="C-term Amide"
YCQAWMWTCDSKRACCEGLRCKLWCRKII

SEQ ID NO: 6 - protein, 29 aa, Artificial Sequence
  source: /note="Description of Artificial Sequence: Synthetic peptide"
  source: /note="N-term Amino group"
  source: /note="C-term Amide"
YCQKAMWTCDSKRACCEGLRCKLWCRKII

SEQ ID NO: 7 - protein, 29 aa, Artificial Sequence
  source: /note="Description of Artificial Sequence: Synthetic peptide"
  source: /note="N-term Amino group"
  source: /note="C-term Amide"
YCQKWAWTCDSKRACCEGLRCKLWCRKII

SEQ ID NO: 8 - protein, 29 aa, Artificial Sequence
  source: /note="Description of Artificial Sequence: Synthetic peptide"
  source: /note="N-term Amino group"
  source: /note="C-term Amide"
YCQKWMATCDSKRACCEGLRCKLWCRKII

SEQ ID NO: 9 - protein, 29 aa, Artificial Sequence
  source: /note="Description of Artificial Sequence: Synthetic peptide"
  source: /note="N-term Amino group"
  source: /note="C-term Amide"
YCQKWMWACDSKRACCEGLRCKLWCRKII

SEQ ID NO: 10 - protein, 29 aa, Artificial Sequence
  source: /note="Description of Artificial Sequence: Synthetic peptide"
  source: /note="N-term Amino group"
  source: /note="C-term Amide"
YCQKWMWTCASKRACCEGLRCKLWCRKII

SEQ ID NO: 11 - protein, 29 aa, Artificial Sequence
  source: /note="Description of Artificial Sequence: Synthetic peptide"
  source: /note="N-term Amino group"
  source: /note="C-term Amide"
YCQKWMWTCDAKRACCEGLRCKLWCRKII

SEQ ID NO: 12 - protein, 29 aa, Artificial Sequence
  source: /note="Description of Artificial Sequence: Synthetic peptide"
  source: /note="N-term Amino group"
  source: /note="C-term Amide"
YCQKWMWTCDSARACCEGLRCKLWCRKII

SEQ ID NO: 13 - protein, 29 aa, Artificial Sequence
  source: /note="Description of Artificial Sequence: Synthetic peptide"
  source: /note="N-term Amino group"
  source: /note="C-term Amide"
YCQKWMWTCDSKAACCEGLRCKLWCRKII

SEQ ID NO: 14 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCAGLRCKLWCRKII

SEQ ID NO: 15 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEALRCKLWCRKII

SEQ ID NO: 16 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGARCKLWCRKII

SEQ ID NO: 17 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLACKLWCRKII

SEQ ID NO: 18 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCALWCRKII

SEQ ID NO: 19 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKAWCRKII

SEQ ID NO: 20 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLACRKII

SEQ ID NO: 21 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCAKII

SEQ ID NO: 22 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRAII

SEQ ID NO: 23 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKAI

SEQ ID NO: 24 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKIA

SEQ ID NO: 25 - protein, 29 aa, Artificial Sequence
  source: /note="Description of Artificial Sequence: Synthetic peptide"
  source: /note="N-term Amino group"
  MOD_RES (1)..(1): 1-Nal
  source: /note="C-term Amide"
ACQKWMWTCDSKRACCEGLRCKLWCRKII

SEQ ID NO: 26 - protein, 29 aa, Artificial Sequence
  source: /note="Description of Artificial Sequence: Synthetic peptide"
  source: /note="N-term Amino group"
  MOD_RES (3)..(3): 1-Nal
  source: /note="C-term Amide"
YCAKWMWTCDSKRACCEGLRCKLWCRKII

SEQ ID NO: 27 - protein, 29 aa, Artificial Sequence
  source: /note="Description of Artificial Sequence: Synthetic peptide"
  source: /note="N-term Amino group"
  MOD_RES (4)..(4): 1-Nal
  source: /note="C-term Amide"
YCQAWMWTCDSKRACCEGLRCKLWCRKII

SEQ ID NO: 28 - protein, 29 aa, Artificial Sequence
  source: /note="Description of Artificial Sequence: Synthetic peptide"
  source: /note="N-term Amino group"
  MOD_RES (5)..(5): 1-Nal
  source: /note="C-term Amide"
YCQKAMWTCDSKRACCEGLRCKLWCRKII

SEQ ID NO: 29 - protein, 29 aa, Artificial Sequence
  source: /note="Description of Artificial Sequence: Synthetic peptide"
  source: /note="N-term Amino group"
  MOD_RES (6)..(6): 1-Nal
  source: /note="C-term Amide"
YCQKWAWTCDSKRACCEGLRCKLWCRKII

SEQ ID NO: 30 - protein, 29 aa, Artificial Sequence
  source: /note="Description of Artificial Sequence: Synthetic peptide"
  source: /note="N-term Amino group"
  MOD_RES (7)..(7): 1-Nal
  source: /note="C-term Amide"
YCQKWMATCDSKRACCEGLRCKLWCRKII

SEQ ID NO: 31 - protein, 29 aa, Artificial Sequence
  source: /note="Description of Artificial Sequence: Synthetic peptide"
  source: /note="N-term Amino group"
  MOD_RES (8)..(8): 1-Nal
  source: /note="C-term Amide"
YCQKWMWACDSKRACCEGLRCKLWCRKII

SEQ ID NO: 32 - protein, 29 aa, Artificial Sequence
  source: /note="Description of Artificial Sequence: Synthetic peptide"
  source: /note="N-term Amino group"
  MOD_RES (10)..(10): 1-Nal
  source: /note="C-term Amide"
YCQKWMWTCASKRACCEGLRCKLWCRKII

SEQ ID NO: 33 - protein, 29 aa, Artificial Sequence
  source: /note="Description of Artificial Sequence: Synthetic peptide"
  source: /note="N-term Amino group"
  MOD_RES (11)..(11): 1-Nal
  source: /note="C-term Amide"
YCQKWMWTCDAKRACCEGLRCKLWCRKII

SEQ ID NO: 34 - protein, 29 aa, Artificial Sequence
  source: /note="Description of Artificial Sequence: Synthetic peptide"
  source: /note="N-term Amino group"
  MOD_RES (12)..(12): 1-Nal
  source: /note="C-term Amide"
YCQKWMWTCDSARACCEGLRCKLWCRKII

SEQ ID NO: 35 - protein, 29 aa, Artificial Sequence
  source: /note="Description of Artificial Sequence: Synthetic peptide"
  source: /note="N-term Amino group"
  MOD_RES (13)..(13): 1-Nal
  source: /note="C-term Amide"
YCQKWMWTCDSKAACCEGLRCKLWCRKII

SEQ ID NO: 36 - protein, 29 aa, Artificial Sequence
  source: /note="Description of Artificial Sequence: Synthetic peptide"
  source: /note="N-term Amino group"
  MOD_RES (14)..(14): 1-Nal
  source: /note="C-term Amide"
YCQKWMWTCDSKRACCEGLRCKLWCRKII

SEQ ID NO: 37 - protein, 29 aa, Artificial Sequence
  source: /note="Description of Artificial Sequence: Synthetic peptide"
  source: /note="N-term Amino group"
  MOD_RES (17)..(17): 1-Nal
  source: /note="C-term Amide"
YCQKWMWTCDSKRACCAGLRCKLWCRKII

SEQ ID NO: 38 - protein, 29 aa, Artificial Sequence
  source: /note="Description of Artificial Sequence: Synthetic peptide"
  source: /note="N-term Amino group"
  MOD_RES (18)..(18): 1-Nal
  source: /note="C-term Amide"
YCQKWMWTCDSKRACCEALRCKLWCRKII

SEQ ID NO: 39 - protein, 29 aa, Artificial Sequence
  source: /note="Description of Artificial Sequence: Synthetic peptide"
  source: /note="N-term Amino group"
  MOD_RES (19)..(19): 1-Nal
  source: /note="C-term Amide"
YCQKWMWTCDSKRACCEGARCKLWCRKII

SEQ ID NO: 40 - protein, 29 aa, Artificial Sequence
  source: /note="Description of Artificial Sequence: Synthetic peptide"
  source: /note="N-term Amino group"
  MOD_RES (20)..(20): 1-Nal
  source: /note="C-term Amide"
YCQKWMWTCDSKRACCEGLACKLWCRKII

SEQ ID NO: 41 - protein, 29 aa, Artificial Sequence
  source: /note="Description of Artificial Sequence: Synthetic peptide"
  source: /note="N-term Amino group"
  MOD_RES (22)..(22): 1-Nal
  source: /note="C-term Amide"
YCQKWMWTCDSKRACCEGLRCALWCRKII

SEQ ID NO: 42 - protein, 29 aa, Artificial Sequence
  source: /note="Description of Artificial Sequence: Synthetic peptide"
  source: /note="N-term Amino group"
  MOD_RES (23)..(23): 1-Nal
  source: /note="C-term Amide"
YCQKWMWTCDSKRACCEGLRCKAWCRKII

SEQ ID NO: 43 - protein, 29 aa, Artificial Sequence
  source: /note="Description of Artificial Sequence: Synthetic peptide"
  source: /note="N-term Amino group"
  MOD_RES (24)..(24): 1-Nal
  source: /note="C-term Amide"
YCQKWMWTCDSKRACCEGLRCKLACRKII

SEQ ID NO: 44 - protein, 29 aa, Artificial Sequence
  source: /note="Description of Artificial Sequence: Synthetic peptide"
  source: /note="N-term Amino group"
  MOD_RES (26)..(26): 1-Nal
  source: /note="C-term Amide"
YCQKWMWTCDSKRACCEGLRCKLWCAKII

SEQ ID NO: 45 - protein, 29 aa, Artificial Sequence
  source: /note="Description of Artificial Sequence: Synthetic peptide"
  source: /note="N-term Amino group"
  MOD_RES (27)..(27): 1-Nal
  source: /note="C-term Amide"
YCQKWMWTCDSKRACCEGLRCKLWCRAII

SEQ ID NO: 46 - protein, 29 aa, Artificial Sequence
  source: /note="Description of Artificial Sequence: Synthetic peptide"
  source: /note="N-term Amino group"
  MOD_RES (28)..(28): 1-Nal
  source: /note="C-term Amide"
YCQKWMWTCDSKRACCEGLRCKLWCRKAI

SEQ ID NO: 47 - protein, 29 aa, Artificial Sequence
  source: /note="Description of Artificial Sequence: Synthetic peptide"
  source: /note="N-term Amino group"
  MOD_RES (29)..(29): 1-Nal
  source: /note="C-term Amide"
YCQKWMWTCDSKRACCEGLRCKLWCRKIA

SEQ ID NO: 48 - protein, 29 aa, Chilobrachys jingzhao
YCQKWMWTCDSERKCCEGYVCELWCKYNL

SEQ ID NO: 49 - protein, 29 aa, Artificial Sequence
  source: /note="Description of Artificial Sequence: Synthetic peptide"
  source: /note="N-term Amino group"
  source: /note="C-term Amide"
ECQKWMWTCDSKRACCEGLRCKLWCRKII

SEQ ID NO: 50 - protein, 29 aa, Artificial Sequence
  source: /note="Description of Artificial Sequence: Synthetic peptide"
  source: /note="N-term Amino group"
  source: /note="C-term Amide"
YCEKWMWTCDSKRACCEGLRCKLWCRKII

SEQ ID NO: 51 - protein, 29 aa, Artificial Sequence
  source: /note="Description of Artificial Sequence: Synthetic peptide"
  source: /note="N-term Amino group"
  source: /note="C-term Amide"
YCQEWMWTCDSKRACCEGLRCKLWCRKII

SEQ ID NO: 52 - protein, 29 aa, Artificial Sequence
  source: /note="Description of Artificial Sequence: Synthetic peptide"
  source: /note="N-term Amino group"
  source: /note="C-term Amide"
YCQKEMWTCDSKRACCEGLRCKLWCRKII

SEQ ID NO: 53 - protein, 29 aa, Artificial Sequence
  source: /note="Description of Artificial Sequence: Synthetic peptide"
  source: /note="N-term Amino group"
  source: /note="C-term Amide"
YCQKWEWTCDSKRACCEGLRCKLWCRKII

SEQ ID NO: 54 - protein, 29 aa, Artificial Sequence
  source: /note="Description of Artificial Sequence: Synthetic peptide"
  source: /note="N-term Amino group"
  source: /note="C-term Amide"
YCQKWMETCDSKRACCEGLRCKLWCRKII

SEQ ID NO: 55 - protein, 29 aa, Artificial Sequence
  source: /note="Description of Artificial Sequence: Synthetic peptide"
  source: /note="N-term Amino group"
  source: /note="C-term Amide"
YCQKWMWECDSKRACCEGLRCKLWCRKII

SEQ ID NO: 56 - protein, 29 aa, Artificial Sequence
  source: /note="Description of Artificial Sequence: Synthetic peptide"
  source: /note="N-term Amino group"
  source: /note="C-term Amide"
YCQKWMWTCESKRACCEGLRCKLWCRKII

SEQ ID NO: 57 - protein, 29 aa, Artificial Sequence
  source: /note="Description of Artificial Sequence: Synthetic peptide"
  source: /note="N-term Amino group"
  source: /note="C-term Amide"
YCQKWMWTCDEKRACCEGLRCKLWCRKII

SEQ ID NO: 58 - protein, 29 aa, Artificial Sequence
  source: /note="Description of Artificial Sequence: Synthetic peptide"
  source: /note="N-term Amino group"
  source: /note="C-term Amide"
YCQKWMWTCDSERACCEGLRCKLWCRKII

SEQ ID NO: 59 - protein, 29 aa, Artificial Sequence
  source: /note="Description of Artificial Sequence: Synthetic peptide"
  source: /note="N-term Amino group"
  source: /note="C-term Amide"
YCQKWMWTCDSKEACCEGLRCKLWCRKII

SEQ ID NO: 60 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRECCEGLRCKLWCRKII

SEQ ID NO: 61 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEELRCKLWCRKII

SEQ ID NO: 62 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGERCKLWCRKII

SEQ ID NO: 63 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKII

SEQ ID NO: 64 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCELWCRKII

SEQ ID NO: 65 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKEWCRKII

SEQ ID NO: 66 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLECRKII

SEQ ID NO: 67 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCEKII

SEQ ID NO: 68 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCREII

SEQ ID NO: 69 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKEI

SEQ ID NO: 70 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKIE

SEQ ID NO: 71 - protein, 29 aa, Artificial Sequence
  source: /note="Description of Artificial Sequence: Synthetic peptide"
  source: /note="N-term Amino group"
  source: /note="C-term Amide"
KCQKWMWTCDSKRACCEGLRCKLWCRKII

SEQ ID NO: 72 - protein, 29 aa, Artificial Sequence
  source: /note="Description of Artificial Sequence: Synthetic peptide"
  source: /note="N-term Amino group"
  source: /note="C-term Amide"
YCKKWMWTCDSKRACCEGLRCKLWCRKII

SEQ ID NO: 73 - protein, 29 aa, Artificial Sequence
  source: /note="Description of Artificial Sequence: Synthetic peptide"
  source: /note="N-term Amino group"
  source: /note="C-term Amide"
YCQKKMWTCDSKRACCEGLRCKLWCRKII

SEQ ID NO: 74 - protein, 29 aa, Artificial Sequence
  source: /note="Description of Artificial Sequence: Synthetic peptide"
  source: /note="N-term Amino group"
  source: /note="C-term Amide"
YCQKWKWTCDSKRACCEGLRCKLWCRKII

SEQ ID NO: 75 - protein, 29 aa, Artificial Sequence
  source: /note="Description of Artificial Sequence: Synthetic peptide"
  source: /note="N-term Amino group"
  source: /note="C-term Amide"
YCQKWMKTCDSKRACCEGLRCKLWCRKII

SEQ ID NO: 76 - protein, 29 aa, Artificial Sequence
  source: /note="Description of Artificial Sequence: Synthetic peptide"
  source: /note="N-term Amino group"
  source: /note="C-term Amide"
YCQKWMWKCDSKRACCEGLRCKLWCRKII

SEQ ID NO: 77 - protein, 29 aa, Artificial Sequence
  source: /note="Description of Artificial Sequence: Synthetic peptide"
  source: /note="N-term Amino group"
  source: /note="C-term Amide"
YCQKWMWTCKSKRACCEGLRCKLWCRKII

SEQ ID NO: 78 - protein, 29 aa, Artificial Sequence
  source: /note="Description of Artificial Sequence: Synthetic peptide"
  source: /note="N-term Amino group"
  source: /note="C-term Amide"
YCQKWMWTCDKKRACCEGLRCKLWCRKII

SEQ ID NO: 79 - protein, 29 aa, Artificial Sequence
  source: /note="Description of Artificial Sequence: Synthetic peptide"
  source: /note="N-term Amino group"
  source: /note="C-term Amide"
YCQKWMWTCDSKKACCEGLRCKLWCRKII

SEQ ID NO: 80 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRKCCEGLRCKLWCRKII

SEQ ID NO: 81 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCKGLRCKLWCRKII

SEQ ID NO: 82 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEKLRCKLWCRKII

SEQ ID NO: 83 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGKRCKLWCRKII

SEQ ID NO: 84 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLKCKLWCRKII

SEQ ID NO: 85 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKKWCRKII

SEQ ID NO: 86 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLKCRKII

SEQ ID NO: 87 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCKKII

SEQ ID NO: 88 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKKI

SEQ ID NO: 89 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKIK

SEQ ID NO: 90 - protein, 29 aa, Artificial Sequence
  source: /note="Description of Artificial Sequence: Synthetic peptide"
  source: /note="N-term Amino group"
  source: /note="C-term Amide"
RCQKWMWTCDSKRACCEGLRCKLWCRKII

SEQ ID NO: 91 - protein, 29 aa, Artificial Sequence
  source: /note="Description of Artificial Sequence: Synthetic peptide"
  source: /note="N-term Amino group"
  source: /note="C-term Amide"
YCRKWMWTCDSKRACCEGLRCKLWCRKII

SEQ ID NO: 92 - protein, 29 aa, Artificial Sequence
  source: /note="Description of Artificial Sequence: Synthetic peptide"
  source: /note="N-term Amino group"
  source: /note="C-term Amide"
YCQRWMWTCDSKRACCEGLRCKLWCRKII

SEQ ID NO: 93 - protein, 29 aa, Artificial Sequence
  source: /note="Description of Artificial Sequence: Synthetic peptide"
  source: /note="N-term Amino group"
  source: /note="C-term Amide"
YCQKRMWTCDSKRACCEGLRCKLWCRKII

SEQ ID NO: 94 - protein, 29 aa, Artificial Sequence
  source: /note="Description of Artificial Sequence: Synthetic peptide"
  source: /note="N-term Amino group"
  source: /note="C-term Amide"
YCQKWRWTCDSKRACCEGLRCKLWCRKII

SEQ ID NO: 95 - protein, 29 aa, Artificial Sequence
  source: /note="Description of Artificial Sequence: Synthetic peptide"
  source: /note="N-term Amino group"
  source: /note="C-term Amide"
YCQKWMRTCDSKRACCEGLRCKLWCRKII

SEQ ID NO: 96 - protein, 29 aa, Artificial Sequence
  source: /note="Description of Artificial Sequence: Synthetic peptide"
  source: /note="N-term Amino group"
  source: /note="C-term Amide"
YCQKWMWRCDSKRACCEGLRCKLWCRKII

SEQ ID NO: 97 - protein, 29 aa, Artificial Sequence
  source: /note="Description of Artificial Sequence: Synthetic peptide"
  source: /note="N-term Amino group"
  source: /note="C-term Amide"
YCQKWMWTCRSKRACCEGLRCKLWCRKII

SEQ ID NO: 98 - protein, 29 aa, Artificial Sequence
  source: /note="Description of Artificial Sequence: Synthetic peptide"
  source: /note="N-term Amino group"
  source: /note="C-term Amide"
YCQKWMWTCDRKRACCEGLRCKLWCRKII

SEQ ID NO: 99 - protein, 29 aa, Artificial Sequence
  source: /note="Description of Artificial Sequence: Synthetic peptide"
  source: /note="N-term Amino group"
  source: /note="C-term Amide"
YCQKWMWTCDSRRACCEGLRCKLWCRKII

SEQ ID NO: 100 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRRCCEGLRCKLWCRKII

SEQ ID NO: 101 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCRGLRCKLWCRKII

SEQ ID NO: 102 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCERLRCKLWCRKII

SEQ ID NO: 103 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGRRCKLWCRKII

SEQ ID NO: 104 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCRLWCRKII

SEQ ID NO: 105 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKRWCRKII

SEQ ID NO: 106 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLRCRKII

SEQ ID NO: 107 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRRII

SEQ ID NO: 108 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKRI

SEQ ID NO: 109 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLRCKLWCRKIR

SEQ ID NO: 110 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKII

SEQ ID NO: 111 - protein, 29 aa, Artificial Sequence
  source: /note="Description of Artificial Sequence: Synthetic peptide"
  source: /note="N-term Amino group"
  MOD_RES (6)..(6): Nva
  source: /note="C-term Amide"
YCQKWVWTCDSKRACCEGLECKLWCRKII

SEQ ID NO: 112 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKIW

SEQ ID NO: 113 - protein, 30 aa, Artificial Sequence
  source: /note="Description of Artificial Sequence: Synthetic polypeptide"
  source: /note="N-term Amino group"
  source: /note="C-term Amide"
YCQKWMWTCDSKRACCEGLECKLWCRKIIW

SEQ ID NO: 114 - protein, 29 aa, Artificial Sequence
  source: /note="Description of Artificial Sequence: Synthetic peptide"
  source: /note="N-term Amino group"
  MOD_RES (20)..(20): Cpa
  source: /note="C-term Amide"
YCQKWMWTCDSKRACCEGLFCKLWCRKII

SEQ ID NO: 115 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLDCKLWCRKII

SEQ ID NO: 116 - protein, 29 aa, Artificial Sequence
  source: /note="Description of Artificial Sequence: Synthetic peptide"
  source: /note="N-term Amino group"
  MOD_RES (20)..(20): 4-Cl-Phe
  source: /note="C-term Amide"
YCQKWMWTCDSKRACCEGLFCKLWCRKII

SEQ ID NO: 117 - protein, 29 aa, Artificial Sequence
  source: /note="Description of Artificial Sequence: Synthetic peptide"
  source: /note="N-term Amino group"
  MOD_RES (20)..(20): Abu
  source: /note="C-term Amide"
YCQKWMWTCDSKRACCEGLXCKLWCRKII

SEQ ID NO: 118 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLICKLWCRKII

SEQ ID NO: 119 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLLCKLWCRKII

SEQ ID NO: 120 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLVCKLWCRKII

SEQ ID NO: 121 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLGCKLWCRKII

SEQ ID NO: 122 - protein, 29 aa, Artificial Sequence
  source: /note="Description of Artificial Sequence: Synthetic peptide"
  source: /note="N-term Amino group"
  MOD_RES (20)..(20): Cit
  source: /note="C-term Amide"
YCQKWMWTCDSKRACCEGLXCKLWCRKII

SEQ ID NO: 123 - protein, 29 aa, Artificial Sequence
  source: /note="Description of Artificial Sequence: Synthetic peptide"
  source: /note="N-term Amino group"
  MOD_RES (20)..(20): Nva
  source: /note="C-term Amide"
YCQKWMWTCDSKRACCEGLVCKLWCRKII

SEQ ID NO: 124 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLYCKLWCRKII

SEQ ID NO: 125 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLSCKLWCRKII

SEQ ID NO: 126 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKEI

SEQ ID NO: 127 - protein, 29 aa, Artificial Sequence
  source: /note="Description of Artificial Sequence: Synthetic peptide"
  source: /note="N-term Amino group"
  MOD_RES (28)..(28): Cpa
  source: /note="C-term Amide"
YCQKWMWTCDSKRACCEGLECKLWCRKFI

SEQ ID NO: 128 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKDI

SEQ ID NO: 129 - protein, 29 aa, Artificial Sequence
  source: /note="Description of Artificial Sequence: Synthetic peptide"
  source: /note="N-term Amino group"
  MOD_RES (28)..(28): 4-Cl-Phe
  source: /note="C-term Amide"
YCQKWMWTCDSKRACCEGLECKLWCRKFI

SEQ ID NO: 130 - protein, 29 aa, Artificial Sequence
  source: /note="Description of Artificial Sequence: Synthetic peptide"
  source: /note="N-term Amino group"
  MOD_RES (28)..(28): Abu
  source: /note="C-term Amide"
YCQKWMWTCDSKRACCEGLECKLWCRKXI

SEQ ID NO: 131 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKII

SEQ ID NO: 132 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKLI

SEQ ID NO: 133 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKVI

SEQ ID NO: 134 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKGI

SEQ ID NO: 135 - protein, 29 aa, Artificial Sequence
  source: /note="Description of Artificial Sequence: Synthetic peptide"
  source: /note="N-term Amino group"
  MOD_RES (28)..(28): Cit
  source: /note="C-term Amide"
YCQKWMWTCDSKRACCEGLECKLWCRKXI

SEQ ID NO: 136 - protein, 29 aa, Artificial Sequence
  source: /note="Description of Artificial Sequence: Synthetic peptide"
  source: /note="N-term Amino group"
  MOD_RES (28)..(28): Nva
  source: /note="C-term Amide"
YCQKWMWTCDSKRACCEGLECKLWCRKVI

SEQ ID NO: 137 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYI

SEQ ID NO: 138 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKSI

SEQ ID NO: 139 - protein, 29 aa, Artificial Sequence
  source: /note="Description of Artificial Sequence: Synthetic peptide"
  source: /note="N-term 4-Pen"
  source: /note="C-term Amide"
YCQKWMWTCDSKRACCEGLECKLWCRKII

SEQ ID NO: 140 - protein, 29 aa, Artificial Sequence
  source: /note="Description of Artificial Sequence: Synthetic peptide"
  source: /note="N-term Amino group"
  MOD_RES (1)..(1): Pra
  source: /note="C-term Amide"
GCQKWMWTCDSKRACCEGLECKLWCRKII

SEQ ID NO: 141 - protein, 29 aa, Artificial Sequence
  source: /note="Description of Artificial Sequence: Synthetic peptide"
  source: /note="N-term Amino group"
  MOD_RES (3)..(3): Pra
  source: /note="C-term Amide"
YCGKWMWTCDSKRACCEGLECKLWCRKII

SEQ ID NO: 142 - protein, 29 aa, Artificial Sequence
  source: /note="Description of Artificial Sequence: Synthetic peptide"
  source: /note="N-term Amino group"
  MOD_RES (4)..(4): Pra
  source: /note="C-term Amide"
YCQGWMWTCDSKRACCEGLECKLWCRKII

SEQ ID NO: 143 - protein, 29 aa, Artificial Sequence
  source: /note="Description of Artificial Sequence: Synthetic peptide"
  source: /note="N-term Amino group"
  MOD_RES (5)..(5): Pra
  source: /note="C-term Amide"
YCQKGMWTCDSKRACCEGLECKLWCRKII

SEQ ID NO: 144 - protein, 29 aa, Artificial Sequence
  source: /note="Description of Artificial Sequence: Synthetic peptide"
  source: /note="N-term Amino group"
  MOD_RES (6)..(6): Pra
  source: /note="C-term Amide"
YCQKWGWTCDSKRACCEGLECKLWCRKII

SEQ ID NO: 145 - protein, 29 aa, Artificial Sequence
  source: /note="Description of Artificial Sequence: Synthetic peptide"
  source: /note="N-term Amino group"
  MOD_RES (7)..(7): Pra
  source: /note="C-term Amide"
YCQKWMGTCDSKRACCEGLECKLWCRKII

SEQ ID NO: 146 - protein, 29 aa, Artificial Sequence
  source: /note="Description of Artificial Sequence: Synthetic peptide"
  source: /note="N-term Amino group"
  MOD_RES (8)..(8): Pra
  source: /note="C-term Amide"
YCQKWMWGCDSKRACCEGLECKLWCRKII

SEQ ID NO: 147 - protein, 29 aa, Artificial Sequence
  source: /note="Description of Artificial Sequence: Synthetic peptide"
  source: /note="N-term Amino group"
  MOD_RES (9)..(9): Pra
  source: /note="C-term Amide"
YCQKWMWTGDSKRACCEGLECKLWCRKII

SEQ ID NO: 148 - protein, 29 aa, Artificial Sequence
  source: /note="Description of Artificial Sequence: Synthetic peptide"
  source: /note="N-term Amino group"
  MOD_RES (10)..(10): Pra
  source: /note="C-term Amide"
YCQKWMWTCGSKRACCEGLECKLWCRKII

SEQ ID NO: 149 - protein, 29 aa, Artificial Sequence
  source: /note="Description of Artificial Sequence: Synthetic peptide"
  source: /note="N-term Amino group"
  MOD_RES (11)..(11): Pra
  source: /note="C-term Amide"
YCQKWMWTCDGKRACCEGLECKLWCRKII

SEQ ID NO: 150 - protein, 29 aa, Artificial Sequence
  source: /note="Description of Artificial Sequence: Synthetic peptide"
  source: /note="N-term Amino group"
  MOD_RES (12)..(12): Pra
  source: /note="C-term Amide"
YCQKWMWTCDSGRACCEGLECKLWCRKII

SEQ ID NO: 151 - protein, 29 aa, Artificial Sequence
  source: /note="Description of Artificial Sequence: Synthetic peptide"
  source: /note="N-term Amino group"
  MOD_RES (13)..(13): Pra
  source: /note="C-term Amide"
YCQKWMWTCDSKGACCEGLECKLWCRKII

SEQ ID NO: 152 - protein, 29 aa, Artificial Sequence
  source: /note="Description of Artificial Sequence: Synthetic peptide"
  source: /note="N-term Amino group"
  MOD_RES (14)..(14): Pra
  source: /note="C-term Amide"
YCQKWMWTCDSKRGCCEGLECKLWCRKII

SEQ ID NO: 153 - protein, 29 aa, Artificial Sequence
  source: /note="Description of Artificial Sequence: Synthetic peptide"
  source: /note="N-term Amino group"
  MOD_RES (17)..(17): Pra
  source: /note="C-term Amide"
YCQKWMWTCDSKRACCGGLECKLWCRKII

SEQ ID NO: 154 - protein, 29 aa, Artificial Sequence
  source: /note="Description of Artificial Sequence: Synthetic peptide"
  source: /note="N-term Amino group"
  MOD_RES (18)..(18): Pra
  source: /note="C-term Amide"
YCQKWMWTCDSKRACCEGLECKLWCRKII

SEQ ID NO: 155 - protein, 29 aa, Artificial Sequence
  source: /note="Description of Artificial Sequence: Synthetic peptide"
  source: /note="N-term Amino group"
  MOD_RES (19)..(19): Pra
  source: /note="C-term Amide"
YCQKWMWTCDSKRACCEGGECKLWCRKII

SEQ ID NO: 156 - protein, 29 aa, Artificial Sequence
  source: /note="Description of Artificial Sequence: Synthetic peptide"
  source: /note="N-term Amino group"
  MOD_RES (20)..(20): Pra
  source: /note="C-term Amide"
YCQKWMWTCDSKRACCEGLGCKLWCRKII

SEQ ID NO: 157 - protein, 29 aa, Artificial Sequence
  source: /note="Description of Artificial Sequence: Synthetic peptide"
  source: /note="N-term Amino group"
  MOD_RES (22)..(22): Pra
  source: /note="C-term Amide"
YCQKWMWTCDSKRACCEGLECGLWCRKII

SEQ ID NO: 158 - protein, 29 aa, Artificial Sequence
  source: /note="Description of Artificial Sequence: Synthetic peptide"
  source: /note="N-term Amino group"
  MOD_RES (23)..(23): Pra
  source: /note="C-term Amide"
YCQKWMWTCDSKRACCEGLECKGWCRKII

SEQ ID NO: 159 - protein, 29 aa, Artificial Sequence
  source: /note="Description of Artificial Sequence: Synthetic peptide"
  source: /note="N-term Amino group"
  MOD_RES (24)..(24): Pra
  source: /note="C-term Amide"
YCQKWMWTCDSKRACCEGLECKLGCRKII

SEQ ID NO: 160 - protein, 29 aa, Artificial Sequence
  source: /note="Description of Artificial Sequence: Synthetic peptide"
  source: /note="N-term Amino group"
  MOD_RES (26)..(26): Pra
  source: /note="C-term Amide"
YCQKWMWTCDSKRACCEGLECKLWCGKII

SEQ ID NO: 161 - protein, 29 aa, Artificial Sequence
  source: /note="Description of Artificial Sequence: Synthetic peptide"
  source: /note="N-term Amino group"
  MOD_RES (27)..(27): Pra
  source: /note="C-term Amide"
YCQKWMWTCDSKRACCEGLECKLWCRGII

SEQ ID NO: 162 - protein, 29 aa, Artificial Sequence
  source: /note="Description of Artificial Sequence: Synthetic peptide"
  source: /note="N-term Amino group"
  MOD_RES (28)..(28): Pra
  source: /note="C-term Amide"
YCQKWMWTCDSKRACCEGLECKLWCRKGI

SEQ ID NO: 163 - protein, 29 aa, Artificial Sequence
  source: /note="Description of Artificial Sequence: Synthetic peptide"
  source: /note="N-term Amino group"
  MOD_RES (29)..(29): Pra
  source: /note="C-term Amide"
YCQKWMWTCDSKRACCEGLECKLWCRKIG

SEQ ID NO: 164 - protein, 29 aa, Artificial Sequence
  source: /note="Description of Artificial Sequence: Synthetic peptide"
  source: /note="N-term 4-Pen
  source: /note="C-term Amide"
YCQKWMWTCDSKRACCEGLECKLWCRKII

SEQ ID NO: 165 - protein, 29 aa, Artificial Sequence
  source: /note="Description of Artificial Sequence: Synthetic peptide"
  source: /note="N-term Amino group"
  MOD_RES (1)..(1): Atz(PEG10)
  source: /note="C-term Amide"
ACQKWMWTCDSKRACCEGLECKLWCRKII

SEQ ID NO: 166 - protein, 29 aa, Artificial Sequence
  source: /note="Description of Artificial Sequence: Synthetic peptide"
  source: /note="N-term Amino group"
  MOD_RES (3)..(3): Atz(PEG10)
  source: /note="C-term Amide"
YCAKWMWTCDSKRACCEGLECKLWCRKII

SEQ ID NO: 167 - protein, 29 aa, Artificial Sequence
  source: /note="Description of Artificial Sequence: Synthetic peptide"
  source: /note="N-term Amino group"
  MOD_RES (4)..(4): Atz(PEG10)
  source: /note="C-term Amide"
YCQAWMWTCDSKRACCEGLECKLWCRKII

SEQ ID NO: 168 - protein, 29 aa, Artificial Sequence
  source: /note="Description of Artificial Sequence: Synthetic peptide"
  source: /note="N-term Amino group"
  MOD_RES (5)..(5): Atz(PEG10)
  source: /note="C-term Amide"
YCQKAMWTCDSKRACCEGLECKLWCRKII

SEQ ID NO: 169 - protein, 29 aa, Artificial Sequence
  source: /note="Description of Artificial Sequence: Synthetic peptide"
  source: /note="N-term Amino group"
  MOD_RES (6)..(6): Atz(PEG10)
  source: /note="C-term Amide"
YCQKWAWTCDSKRACCEGLECKLWCRKII

SEQ ID NO: 170 - protein, 29 aa, Artificial Sequence
  source: /note="Description of Artificial Sequence: Synthetic peptide"
  source: /note="N-term Amino group"
  MOD_RES (7)..(7): Atz(PEG10)
  source: /note="C-term Amide"
YCQKWMATCDSKRACCEGLECKLWCRKII

SEQ ID NO: 171 - protein, 29 aa, Artificial Sequence
  source: /note="Description of Artificial Sequence: Synthetic peptide"
  source: /note="N-term Amino group"
  MOD_RES (8)..(8): Atz(PEG10)
  source: /note="C-term Amide"
YCQKWMWACDSKRACCEGLECKLWCRKII

SEQ ID NO: 172 - protein, 29 aa, Artificial Sequence
  source: /note="Description of Artificial Sequence: Synthetic peptide"
  source: /note="N-term Amino group"
  MOD_RES (9)..(9): Atz(PEG10)
  source: /note="C-term Amide"
YCQKWMWTADSKRACCEGLECKLWCRKII

SEQ ID NO: 173 - protein, 29 aa, Artificial Sequence
  source: /note="Description of Artificial Sequence: Synthetic peptide"
  source: /note="N-term Amino group"
  MOD_RES (10)..(10): Atz(PEG10)
  source: /note="C-term Amide"
YCQKWMWTCASKRACCEGLECKLWCRKII

SEQ ID NO: 174 - protein, 29 aa, Artificial Sequence
  source: /note="Description of Artificial Sequence: Synthetic peptide"
  source: /note="N-term Amino group"
  MOD_RES (11)..(11): Atz(PEG10)
  source: /note="C-term Amide"
YCQKWMWTCDAKRACCEGLECKLWCRKII

SEQ ID NO: 175 - protein, 29 aa, Artificial Sequence
  source: /note="Description of Artificial Sequence: Synthetic peptide"
  source: /note="N-term Amino group"
  MOD_RES (12)..(12): Atz(PEG10)
  source: /note="C-term Amide"
YCQKWMWTCDSARACCEGLECKLWCRKII

SEQ ID NO: 176 - protein, 29 aa, Artificial Sequence
  source: /note="Description of Artificial Sequence: Synthetic peptide"
  source: /note="N-term Amino group"
  MOD_RES (13)..(13): Atz(PEG10)
  source: /note="C-term Amide"
YCQKWMWTCDSKAACCEGLECKLWCRKII

SEQ ID NO: 177 - protein, 29 aa, Artificial Sequence
  source: /note="Description of Artificial Sequence: Synthetic peptide"
  source: /note="N-term Amino group"
  MOD_RES (14)..(14): Atz(PEG10)
  source: /note="C-term Amide"
YCQKWMWTCDSKRACCEGLECKLWCRKII

SEQ ID NO: 178 - protein, 29 aa, Artificial Sequence
  source: /note="Description of Artificial Sequence: Synthetic peptide"
  source: /note="N-term Amino group"
  MOD_RES (17)..(17): Atz(PEG10)
  source: /note="C-term Amide"
YCQKWMWTCDSKRACCAGLECKLWCRKII

SEQ ID NO: 179 - protein, 29 aa, Artificial Sequence
  source: /note="Description of Artificial Sequence: Synthetic peptide"
  source: /note="N-term Amino group"
  MOD_RES (18)..(18): Atz(PEG10)
  source: /note="C-term Amide"
YCQKWMWTCDSKRACCEALECKLWCRKII

SEQ ID NO: 180 - protein, 29 aa, Artificial Sequence
  source: /note="Description of Artificial Sequence: Synthetic peptide"
  source: /note="N-term Amino group"
  MOD_RES (19)..(19): Atz(PEG10)
  source: /note="C-term Amide"
YCQKWMWTCDSKRACCEGAECKLWCRKII

SEQ ID NO: 181 - protein, 29 aa, Artificial Sequence
  source: /note="Description of Artificial Sequence: Synthetic peptide"
  source: /note="N-term Amino group"
  MOD_RES (20)..(20): Atz(PEG10)
  source: /note="C-term Amide"
YCQKWMWTCDSKRACCEGLACKLWCRKII

SEQ ID NO: 182 - protein, 29 aa, Artificial Sequence
  source: /note="Description of Artificial Sequence: Synthetic peptide"
  source: /note="N-term Amino group"
  MOD_RES (22)..(22): Atz(PEG10)
  source: /note="C-term Amide"
YCQKWMWTCDSKRACCEGLECALWCRKII

SEQ ID NO: 183 - protein, 29 aa, Artificial Sequence
  source: /note="Description of Artificial Sequence: Synthetic peptide"
  source: /note="N-term Amino group"
  MOD_RES (23)..(23): Atz(PEG10)
  source: /note="C-term Amide"
YCQKWMWTCDSKRACCEGLECKAWCRKII

SEQ ID NO: 184 - protein, 29 aa, Artificial Sequence
  source: /note="Description of Artificial Sequence: Synthetic peptide"
  source: /note="N-term Amino group"
  MOD_RES (24)..(24): Atz(PEG10)
  source: /note="C-term Amide"
YCQKWMWTCDSKRACCEGLECKLACRKII

SEQ ID NO: 185 - protein, 29 aa, Artificial Sequence
  source: /note="Description of Artificial Sequence: Synthetic peptide"
  source: /note="N-term Amino group"
  MOD_RES (26)..(26): Atz(PEG10)
  source: /note="C-term Amide"
YCQKWMWTCDSKRACCEGLECKLWCAKII

SEQ ID NO: 186 - protein, 29 aa, Artificial Sequence
  source: /note="Description of Artificial Sequence: Synthetic peptide"
  source: /note="N-term Amino group"
  MOD_RES (27)..(27): Atz(PEG10)
  source: /note="C-term Amide"
YCQKWMWTCDSKRACCEGLECKLWCRAII

SEQ ID NO: 187 - protein, 29 aa, Artificial Sequence
  source: /note="Description of Artificial Sequence: Synthetic peptide"
  source: /note="N-term Amino group"
  MOD_RES (28)..(28): Atz(PEG10)
  source: /note="C-term Amide"
YCQKWMWTCDSKRACCEGLECKLWCRKAI

SEQ ID NO: 188 - protein, 29 aa, Artificial Sequence
  source: /note="Description of Artificial Sequence: Synthetic peptide"
  source: /note="N-term Amino group"
  MOD_RES (29)..(29): Atz(PEG10)
  source: /note="C-term Amide"
YCQKWMWTCDSKRACCEGLECKLWCRKIA

SEQ ID NO: 189 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKYI

SEQ ID NO: 190 - protein, 29 aa, Artificial Sequence
  source: /note="Description of Artificial Sequence: Synthetic peptide"
  source: /note="N-term Amino group"
  MOD_RES (5)..(5): 1-Nal
  source: /note="C-term Amide"
YCQKAMWTCDSKRACCEGLECKLWCRKYI

SEQ ID NO: 191 - protein, 29 aa, Artificial Sequence
  source: /note="Description of Artificial Sequence: Synthetic peptide"
  source: /note="N-term Amino group"
  MOD_RES (5)..(5): 2-Nal
  source: /note="C-term Amide"
YCQKAMWTCDSKRACCEGLECKLWCRKYI

SEQ ID NO: 192 - protein, 29 aa, Artificial Sequence
  source: /note="Description of Artificial Sequence: Synthetic peptide"
  source: /note="N-term Amino group"
  MOD_RES (5)..(5): pI-Phe
  source: /note="C-term Amide"
YCQKFMWTCDSKRACCEGLECKLWCRKYI

SEQ ID NO: 193 - protein, 29 aa, Artificial Sequence
  source: /note="Description of Artificial Sequence: Synthetic peptide"
  source: /note="N-term Amino group"
  source: /note="C-term Amide"
YCQKFMWTCDSKRACCEGLECKLWCRKYI

SEQ ID NO: 194 - protein, 29 aa, Artificial Sequence
  source: /note="Description of Artificial Sequence: Synthetic peptide"
  source: /note="N-term Amino group"
  source: /note="C-term Amide"
YCQKYMWTCDSKRACCEGLECKLWCRKYI

SEQ ID NO: 195 - protein, 29 aa, Artificial Sequence
  source: /note="Description of Artificial Sequence: Synthetic peptide"
  source: /note="N-term Amino group"
  source: /note="C-term Amide"
YCQKVMWTCDSKRACCEGLECKLWCRKYI

SEQ ID NO: 196 - protein, 29 aa, Artificial Sequence
  source: /note="Description of Artificial Sequence: Synthetic peptide"
  source: /note="N-term Amino group"
  source: /note="C-term Amide"
YCQKLMWTCDSKRACCEGLECKLWCRKYI

SEQ ID NO: 197 - protein, 29 aa, Artificial Sequence
  source: /note="Description of Artificial Sequence: Synthetic peptide"
  source: /note="N-term Amino group"
  MOD_RES (5)..(5): Nle
  source: /note="C-term Amide"
YCQKLMWTCDSKRACCEGLECKLWCRKYI

SEQ ID NO: 198 - protein, 29 aa, Artificial Sequence
  source: /note="Description of Artificial Sequence: Synthetic peptide"
  source: /note="N-term Amino group"
  MOD_RES (5)..(5): Nva
  source: /note="C-term Amide"
YCQKVMWTCDSKRACCEGLECKLWCRKYI

SEQ ID NO: 199 - protein, 29 aa, Artificial Sequence
  source: /note="Description of Artificial Sequence: Synthetic peptide"
  source: /note="N-term Amino group"
  MOD_RES (5)..(5): Cit
  source: /note="C-term Amide"
YCQKXMWTCDSKRACCEGLECKLWCRKYI

SEQ ID NO: 200 - protein, 29 aa, Artificial Sequence
  source: /note="Description of Artificial Sequence: Synthetic peptide"
  source: /note="N-term Amino group"
  source: /note="C-term Amide"
YCQKKMWTCDSKRACCEGLECKLWCRKYI

SEQ ID NO: 201 - protein, 29 aa, Artificial Sequence
  source: /note="Description of Artificial Sequence: Synthetic peptide"
  source: /note="N-term Amino group"
  source: /note="C-term Amide"
YCQKNMWTCDSKRACCEGLECKLWCRKYI

SEQ ID NO: 202 - protein, 29 aa, Artificial Sequence
  source: /note="Description of Artificial Sequence: Synthetic peptide"
  source: /note="N-term Amino group"
  source: /note="C-term Amide"
YCQKSMWTCDSKRACCEGLECKLWCRKYI

SEQ ID NO: 203 - protein, 29 aa, Artificial Sequence
  source: /note="Description of Artificial Sequence: Synthetic peptide"
  source: /note="N-term Amino group"
  source: /note="C-term Amide"
YCQKEMWTCDSKRACCEGLECKLWCRKYI

SEQ ID NO: 204 - protein, 29 aa, Artificial Sequence
  source: /note="Description of Artificial Sequence: Synthetic peptide"
  source: /note="N-term Amino group"
  MOD_RES (7)..(7): 1-Nal
  source: /note="C-term Amide"
YCQKWMATCDSKRACCEGLECKLWCRKYI

SEQ ID NO: 205 - protein, 29 aa, Artificial Sequence
  source: /note="Description of Artificial Sequence: Synthetic peptide"
  source: /note="N-term Amino group"
  MOD_RES (7)..(7): 2-Nal
  source: /note="C-term Amide"
YCQKWMATCDSKRACCEGLECKLWCRKYI

SEQ ID NO: 206 - protein, 29 aa, Artificial Sequence
  source: /note="Description of Artificial Sequence: Synthetic peptide"
  source: /note="N-term Amino group"
  MOD_RES (7)..(7): pI-Phe
  source: /note="C-term Amide"
YCQKWMFTCDSKRACCEGLECKLWCRKYI

SEQ ID NO: 207 - protein, 29 aa, Artificial Sequence
  source: /note="Description of Artificial Sequence: Synthetic peptide"
  source: /note="N-term Amino group"
  source: /note="C-term Amide"
YCQKWMFTCDSKRACCEGLECKLWCRKYI

SEQ ID NO: 208 - protein, 29 aa, Artificial Sequence
  source: /note="Description of Artificial Sequence: Synthetic peptide"
  source: /note="N-term Amino group"
  source: /note="C-term Amide"
YCQKWMYTCDSKRACCEGLECKLWCRKYI

SEQ ID NO: 209 - protein, 29 aa, Artificial Sequence
  source: /note="Description of Artificial Sequence: Synthetic peptide"
  source: /note="N-term Amino group"
  source: /note="C-term Amide"
YCQKWMVTCDSKRACCEGLECKLWCRKYI

SEQ ID NO: 210 - protein, 29 aa, Artificial Sequence
  source: /note="Description of Artificial Sequence: Synthetic peptide"
  source: /note="N-term Amino group"
  source: /note="C-term Amide"
YCQKWMLTCDSKRACCEGLECKLWCRKYI

SEQ ID NO: 211 - protein, 29 aa, Artificial Sequence
  source: /note="Description of Artificial Sequence: Synthetic peptide"
  source: /note="N-term Amino group"
  MOD_RES (7)..(7): Nle
  source: /note="C-term Amide"
YCQKWMLTCDSKRACCEGLECKLWCRKYI

SEQ ID NO: 212 - protein, 29 aa, Artificial Sequence
  source: /note="Description of Artificial Sequence: Synthetic peptide"
  source: /note="N-term Amino group"
  MOD_RES (7)..(7): Nva
  source: /note="C-term Amide"
YCQKWMVTCDSKRACCEGLECKLWCRKYI

SEQ ID NO: 213 - protein, 29 aa, Artificial Sequence
  source: /note="Description of Artificial Sequence: Synthetic peptide"
  source: /note="N-term Amino group"
  MOD_RES (7)..(7): Cit
  source: /note="C-term Amide"
YCQKWMXTCDSKRACCEGLECKLWCRKYI

SEQ ID NO: 214 - protein, 29 aa, Artificial Sequence
  source: /note="Description of Artificial Sequence: Synthetic peptide"
  source: /note="N-term Amino group"
  source: /note="C-term Amide"
YCQKWMKTCDSKRACCEGLECKLWCRKYI

SEQ ID NO: 215 - protein, 29 aa, Artificial Sequence
  source: /note="Description of Artificial Sequence: Synthetic peptide"
  source: /note="N-term Amino group"
  source: /note="C-term Amide"
YCQKWMNTCDSKRACCEGLECKLWCRKYI

SEQ ID NO: 216 - protein, 29 aa, Artificial Sequence
  source: /note="Description of Artificial Sequence: Synthetic peptide"
  source: /note="N-term Amino group"
  source: /note="C-term Amide"
YCQKWMSTCDSKRACCEGLECKLWCRKYI

SEQ ID NO: 217 - protein, 29 aa, Artificial Sequence
  source: /note="Description of Artificial Sequence: Synthetic peptide"
  source: /note="N-term Amino group"
  source: /note="C-term Amide"
YCQKWMETCDSKRACCEGLECKLWCRKYI

SEQ ID NO: 218 - protein, 29 aa, Artificial Sequence
  source: /note="Description of Artificial Sequence: Synthetic peptide"
  source: /note="N-term Amino group"
  MOD_RES (24)..(24): 1-Nal
  source: /note="C-term Amide"
YCQKWMWTCDSKRACCEGLECKLACRKYI

SEQ ID NO: 219 - protein, 29 aa, Artificial Sequence
  source: /note="Description of Artificial Sequence: Synthetic peptide"
  source: /note="N-term Amino group"
  MOD_RES (24)..(24): 2-Nal
  source: /note="C-term Amide"
YCQKWMWTCDSKRACCEGLECKLACRKYI

SEQ ID NO: 220 - protein, 29 aa, Artificial Sequence
  source: /note="Description of Artificial Sequence: Synthetic peptide"
  source: /note="N-term Amino group"
  MOD_RES (24)..(24): pI-Phe
  source: /note="C-term Amide"
YCQKWMWTCDSKRACCEGLECKLFCRKYI

SEQ ID NO: 221 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLFCRKYI

SEQ ID NO: 222 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLYCRKYI

SEQ ID NO: 223 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLVCRKYI

SEQ ID NO: 224 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLLCRKYI

SEQ ID NO: 225 - protein, 29 aa, Artificial Sequence
  source: /note="Description of Artificial Sequence: Synthetic peptide"
  source: /note="N-term Amino group"
  MOD_RES (24)..(24): Nle
  source: /note="C-term Amide"
YCQKWMWTCDSKRACCEGLECKLLCRKYI

SEQ ID NO: 226 - protein, 29 aa, Artificial Sequence
  source: /note="Description of Artificial Sequence: Synthetic peptide"
  source: /note="N-term Amino group"
  MOD_RES (24)..(24): Nva
  source: /note="C-term Amide"
YCQKWMWTCDSKRACCEGLECKLVCRKYI

SEQ ID NO: 227 - protein, 29 aa, Artificial Sequence
  source: /note="Description of Artificial Sequence: Synthetic peptide"
  source: /note="N-term Amino group"
  MOD_RES (24)..(24): Cit
  source: /note="C-term Amide"
YCQKWMWTCDSKRACCEGLECKLXCRKYI

SEQ ID NO: 228 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLKCRKYI

SEQ ID NO: 229 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLNCRKYI

SEQ ID NO: 230 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLSCRKYI

SEQ ID NO: 231 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLECRKYI

SEQ ID NO: 232 - protein, 29 aa, Artificial Sequence
  source: /note="Description of Artificial Sequence: Synthetic peptide"
  source: /note="N-term Amino group"
  MOD_RES (29)..(29): 1-Nal
  source: /note="C-term Amide"
YCQKWMWTCDSKRACCEGLECKLWCRKYA

SEQ ID NO: 233 - protein, 29 aa, Artificial Sequence
  source: /note="Description of Artificial Sequence: Synthetic peptide"
  source: /note="N-term Amino group"
  MOD_RES (29)..(29): 2-Nal
  source: /note="C-term Amide"
YCQKWMWTCDSKRACCEGLECKLWCRKYA

SEQ ID NO: 234 - protein, 29 aa, Artificial Sequence
  source: /note="Description of Artificial Sequence: Synthetic peptide"
  source: /note="N-term Amino group"
  MOD_RES (29)..(29): pI-Phe
  source: /note="C-term Amide"
YCQKWMWTCDSKRACCEGLECKLWCRKYF

SEQ ID NO: 235 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYF

SEQ ID NO: 236 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYY

SEQ ID NO: 237 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYV

SEQ ID NO: 238 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYL

SEQ ID NO: 239 - protein, 29 aa, Artificial Sequence
  source: /note="Description of Artificial Sequence: Synthetic peptide"
  source: /note="N-term Amino group"
  MOD_RES (29)..(29): Nle
  source: /note="C-term Amide"
YCQKWMWTCDSKRACCEGLECKLWCRKYL

SEQ ID NO: 240 - protein, 29 aa, Artificial Sequence
  source: /note="Description of Artificial Sequence: Synthetic peptide"
  source: /note="N-term Amino group"
  MOD_RES (29)..(29): Nva
  source: /note="C-term Amide"
YCQKWMWTCDSKRACCEGLECKLWCRKYV

SEQ ID NO: 241 - protein, 29 aa, Artificial Sequence
  source: /note="Description of Artificial Sequence: Synthetic peptide"
  source: /note="N-term Amino group"
  MOD_RES (29)..(29): Cit
  source: /note="C-term Amide"
YCQKWMWTCDSKRACCEGLECKLWCRKYX

SEQ ID NO: 242 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYK

SEQ ID NO: 243 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYN

SEQ ID NO: 244 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYS

SEQ ID NO: 245 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYE

SEQ ID NO: 246 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKYW

SEQ ID NO: 247 - protein, 30 aa, Artificial Sequence
  source: /note="Description of Artificial Sequence: Synthetic polypeptide"
  source: /note="N-term Amino group"
  MOD_RES (1)..(1): Atz(PEG10)
  MOD_RES (7)..(7): Nle
  source: /note="C-term Amide"
AYCQKWLWTCDSKRACCEGLRCKLWCRKII

SEQ ID NO: 248 - protein, 29 aa, Artificial Sequence
  source: /note="Description of Artificial Sequence: Synthetic peptide"
  source: /note="N-term Amino group"
  MOD_RES (1)..(1): Atz(PEG10)
  MOD_RES (6)..(6): Nle
  source: /note="C-term Amide"
ACQKWLWTCDSKRACCEGLRCKLWCRKII

SEQ ID NO: 249 - protein, 29 aa, Artificial Sequence
  source: /note="Description of Artificial Sequence: Synthetic peptide"
  source: /note="N-term Amino group"
  MOD_RES (3)..(3): Atz(PEG10)
  MOD_RES (6)..(6): Nle
  source: /note="C-term Amide"
YCAKWLWTCDSKRACCEGLRCKLWCRKII

SEQ ID NO: 250 - protein, 29 aa, Artificial Sequence
  source: /note="Description of Artificial Sequence: Synthetic peptide"
  source: /note="N-term Amino group"
  MOD_RES (4)..(4): Atz(PEG10)
  MOD_RES (6)..(6): Nle
  source: /note="C-term Amide"
YCQAWLWTCDSKRACCEGLRCKLWCRKII

SEQ ID NO: 251 - protein, 29 aa, Artificial Sequence
  source: /note="Description of Artificial Sequence: Synthetic peptide"
  source: /note="N-term Amino group"
  MOD_RES (5)..(5): Atz(PEG10)
  MOD_RES (6)..(6): Nle
  source: /note="C-term Amide"
YCQKALWTCDSKRACCEGLRCKLWCRKII

SEQ ID NO: 252 - protein, 29 aa, Artificial Sequence
  source: /note="Description of Artificial Sequence: Synthetic peptide"
  source: /note="N-term Amino group"
  MOD_RES (6)..(6): Atz(PEG10)
  source: /note="C-term Amide"
YCQKWAWTCDSKRACCEGLRCKLWCRKII

SEQ ID NO: 253 - protein, 29 aa, Artificial Sequence
  source: /note="Description of Artificial Sequence: Synthetic peptide"
  source: /note="N-term Amino group"
  MOD_RES (6)..(6): Nle
  MOD_RES (7)..(7): Atz(PEG10)
  source: /note="C-term Amide"
YCQKWLATCDSKRACCEGLRCKLWCRKII

SEQ ID NO: 254 - protein, 29 aa, Artificial Sequence
  source: /note="Description of Artificial Sequence: Synthetic peptide"
  source: /note="N-term Amino group"
  MOD_RES (6)..(6): Nle
  MOD_RES (8)..(8): Atz(PEG10)
  source: /note="C-term Amide"
YCQKWLWACDSKRACCEGLRCKLWCRKII

SEQ ID NO: 255 - protein, 29 aa, Artificial Sequence
  source: /note="Description of Artificial Sequence: Synthetic peptide"
  source: /note="N-term Amino group"
  MOD_RES (6)..(6): Nle
  MOD_RES (10)..(10): Atz(PEG10)
  source: /note="C-term Amide"
YCQKWLWTCASKRACCEGLRCKLWCRKII

SEQ ID NO: 256 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Atz(PEG10)
  source: /note="C-term Amide"
YCQKWLWTCDAKRACCEGLRCKLWCRKII

SEQ ID NO: 257 - protein, 29 aa, Artificial Sequence
  source: /note="Description of Artificial Sequence: Synthetic peptide"
  source: /note="N-term Amino group"
  MOD_RES (6)..(6): Nle
  MOD_RES (12)..(12): Atz(PEG10)
  source: /note="C-term Amide"
YCQKWLWTCDSARACCEGLRCKLWCRKII

SEQ ID NO: 258 - protein, 29 aa, Artificial Sequence
  source: /note="Description of Artificial Sequence: Synthetic peptide"
  source: /note="N-term Amino group"
  MOD_RES (6)..(6): Nle
  MOD_RES (13)..(13): Atz(PEG10)
  source: /note="C-term Amide"
YCQKWLWTCDSKAACCEGLRCKLWCRKII

SEQ ID NO: 259 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Atz(PEG10)
  source: /note="C-term Amide"
YCQKWLWTCDSKRACCEGLRCKLWCRKII

SEQ ID NO: 260 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Atz(PEG10)
  source: /note="C-term Amide"
YCQKWLWTCDSKRACCAGLRCKLWCRKII

SEQ ID NO: 261 - protein, 29 aa, Artificial Sequence
  source: /note="Description of Artificial Sequence: Synthetic peptide"
  source: /note="N-term Amino group"
  MOD_RES (6)..(6): Nle
  MOD_RES (18)..(18): Atz(PEG10)
  source: /note="C-term Amide"
YCQKWLWTCDSKRACCEALRCKLWCRKII

SEQ ID NO: 262 - protein, 29 aa, Artificial Sequence
  source: /note="Description of Artificial Sequence: Synthetic peptide"
  source: /note="N-term Amino group"
  MOD_RES (6)..(6): Nle
  MOD_RES (19)..(19): Atz(PEG10)
  source: /note="C-term Amide"
YCQKWLWTCDSKRACCEGARCKLWCRKII

SEQ ID NO: 263 - protein, 29 aa, Artificial Sequence
  source: /note="Description of Artificial Sequence: Synthetic peptide"
  source: /note="N-term Amino group"
  MOD_RES (6)..(6): Nle
  MOD_RES (20)..(20): Atz(PEG10)
  source: /note="C-term Amide"
YCQKWLWTCDSKRACCEGLACKLWCRKII

SEQ ID NO: 264 - protein, 29 aa, Artificial Sequence
  source: /note="Description of Artificial Sequence: Synthetic peptide"
  source: /note="N-term Amino group"
  MOD_RES (6)..(6): Nle
  MOD_RES (22)..(22): Atz(PEG10)
  source: /note="C-term Amide"
YCQKWLWTCDSKRACCEGLRCALWCRKII

SEQ ID NO: 265 - protein, 29 aa, Artificial Sequence
  source: /note="Description of Artificial Sequence: Synthetic peptide"
  source: /note="N-term Amino group"
  MOD_RES (6)..(6): Nle
  MOD_RES (23)..(23): Atz(PEG10)
  source: /note="C-term Amide"
YCQKWLWTCDSKRACCEGLRCKAWCRKII

SEQ ID NO: 266 - protein, 29 aa, Artificial Sequence
  source: /note="Description of Artificial Sequence: Synthetic peptide"
  source: /note="N-term Amino group"
  MOD_RES (6)..(6): Nle
  MOD_RES (24)..(24): Atz(PEG10)
  source: /note="C-term Amide"
YCQKWLWTCDSKRACCEGLRCKLACRKII

SEQ ID NO: 267 - protein, 29 aa, Artificial Sequence
  source: /note="Description of Artificial Sequence: Synthetic peptide"
  source: /note="N-term Amino group"
  MOD_RES (6)..(6): Nle
  MOD_RES (26)..(26): Atz(PEG10)
  source: /note="C-term Amide"
YCQKWLWTCDSKRACCEGLRCKLWCAKII

SEQ ID NO: 268 - protein, 29 aa, Artificial Sequence
  source: /note="Description of Artificial Sequence: Synthetic peptide"
  source: /note="N-term Amino group"
  MOD_RES (6)..(6): Nle
  MOD_RES (27)..(27): Atz(PEG10)
  source: /note="C-term Amide"
YCQKWLWTCDSKRACCEGLRCKLWCRAII

SEQ ID NO: 269 - protein, 29 aa, Artificial Sequence
  source: /note="Description of Artificial Sequence: Synthetic peptide"
  source: /note="N-term Amino group"
  MOD_RES (6)..(6): Nle
  MOD_RES (28)..(28): Atz(PEG10)
  source: /note="C-term Amide"
YCQKWLWTCDSKRACCEGLRCKLWCRKAI

SEQ ID NO: 270 - protein, 29 aa, Artificial Sequence
  source: /note="Description of Artificial Sequence: Synthetic peptide"
  source: /note="N-term Amino group"
  MOD_RES (6)..(6): Nle
  MOD_RES (29)..(29): Atz(PEG10)
  source: /note="C-term Amide"
YCQKWLWTCDSKRACCEGLRCKLWCRKIA

SEQ ID NO: 271 - protein, 30 aa, Artificial Sequence
  source: /note="Description of Artificial Sequence: Synthetic polypeptide"
  source: /note="N-term Amino group"
  MOD_RES (6)..(6): Nle
  MOD_RES (30)..(30): Atz(PEG10)
  source: /note="C-term Amide"
YCQKWLWTCDSKRACCEGLRCKLWCRKIIA

SEQ ID NO: 272 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLRCKLWCRKII

SEQ ID NO: 273 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKII

SEQ ID NO: 274 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKIW

SEQ ID NO: 275 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKSI

SEQ ID NO: 276 - protein, 29 aa, Artificial Sequence
  source: /note="Description of Artificial Sequence: Synthetic peptide"
  source: /note="N-term Amino group"
  source: /note="C-term Amide"
YCQKWMWTCDSKRACCEGLECKLWCRKSW

SEQ ID NO: 277 - protein, 29 aa, Artificial Sequence
  source: /note="Description of Artificial Sequence: Synthetic peptide"
  source: /note="N-term Amino group"
  source: /note="C-term Amide"
ECQKWMWTCDSKRACCEGLECKLWCRKYI

SEQ ID NO: 278 - protein, 29 aa, Artificial Sequence
  source: /note="Description of Artificial Sequence: Synthetic peptide"
  source: /note="N-term Amino group"
  source: /note="C-term Amide"
ECQKWMWTCDSKRACCEGLRCKLWCRKYI

SEQ ID NO: 279 - protein, 29 aa, Artificial Sequence
  source: /note="Description of Artificial Sequence: Synthetic peptide"
  source: /note="N-term Amino group"
  source: /note="C-term Amide"
ECQKWMWTCDSKRACCEGLECKLWCRKYW

SEQ ID NO: 280 - protein, 29 aa, Artificial Sequence
  source: /note="Description of Artificial Sequence: Synthetic peptide"
  source: /note="N-term Amino group"
  source: /note="C-term Amide"
ECQKWMWTCDSKRACCEGLRCKLWCRKYW

SEQ ID NO: 281 - protein, 29 aa, Artificial Sequence
  source: /note="Description of Artificial Sequence: Synthetic peptide"
  source: /note="N-term Amino group"
  MOD_RES (7)..(7): 1-Nal
  source: /note="C-term Amide"
ECQKWMATCDSKRACCEGLRCKLWCRKII

SEQ ID NO: 282 - protein, 29 aa, Artificial Sequence
  source: /note="Description of Artificial Sequence: Synthetic peptide"
  source: /note="N-term Amino group"
  MOD_RES (7)..(7): 1-Nal
  source: /note="C-term Amide"
ECQKWMATCDSKRACCEGLRCKLWCRKIW

SEQ ID NO: 283 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Pra
  source: /note="C-term Amide"
YCQKWLWTCDSKRGCCEGLRCKLWCRKII

SEQ ID NO: 284 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Pra
  source: /note="C-term Amide"
YCQKWLWTCDSKRACCGGLECKLWCRKIW

SEQ ID NO: 285 - protein, 29 aa, Artificial Sequence
  source: /note="Description of Artificial Sequence: Synthetic peptide"
  source: /note="N-term Amino group"
  MOD_RES (6)..(6): Nle
  MOD_RES (12)..(12): Lys(ivDde)
  source: /note="C-term Amide"
YCQKWLWTCDSKRKCCEGLECKLWCRKIW

SEQ ID NO: 286 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Lys(Pra-Ahx)
  source: /note="C-term Amide"
YCQKWLWTCDSKRKCCEGLECKLWCRKIW

SEQ ID NO: 287 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Lys(Pra)
  source: /note="C-term Amide"
YCQKWLWTCDSKRKCCEGLECKLWCRKIW

SEQ ID NO: 288 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Lys(ivDde)
  source: /note="C-term Amide"
YCQKWLWTCDSKRKCCEGLECKLWCRKIW

SEQ ID NO: 289 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Lys(ivDde)
  source: /note="C-term Amide"
YCQKWLWTCDSKRACCKGLECKLWCRKIW

SEQ ID NO: 290 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): KPPG11
  source: /note="C-term Amide"
YCQKWLWTCDSKRKCCEGLECKLWCRKIW

SEQ ID NO: 291 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): KPPG3
  source: /note="C-term Amide"
YCQKWLWTCDSKRKCCEGLECKLWCRKIW

SEQ ID NO: 292 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): KPPG11
  source: /note="C-term Amide"
YCQKWLWTCDSKRACCKGLECKLWCRKIW

SEQ ID NO: 293 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): KPPG3
  source: /note="C-term Amide"
YCQKWLWTCDSKRACCKGLECKLWCRKIW

SEQ ID NO: 294 - protein, 29 aa, Artificial Sequence
  source: /note="Description of Artificial Sequence: Synthetic peptide"
  source: /note="N-term Amino group"
  MOD_RES (6)..(6): Nle
  source: /note="C-term Amide"
YCQKWLWTCDSKRACCEGLECKLWCRKIW

SEQ ID NO: 295 - protein, 30 aa, Artificial Sequence
  source: /note="Description of Artificial Sequence: Synthetic polypeptide"
  source: /note="N-term Amino group"
  MOD_RES (1)..(1): Pra
  source: /note="C-term Amide"
GYCQKWMWTCDSKRACCEGLECKLWCRKIW

SEQ ID NO: 296 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKIW

SEQ ID NO: 297 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLECKLWCRKII

SEQ ID NO: 298 - protein, 30 aa, Artificial Sequence
  source: /note="Description of Artificial Sequence: Synthetic polypeptide"
  source: /note="N-term Amino group"
  MOD_RES (1)..(1): Pra
  source: /note="C-term Amide"
GYCQKWFWTCDSKRACCEGLECKLWCRKIW

SEQ ID NO: 299 - protein, 30 aa, Artificial Sequence
  source: /note="Description of Artificial Sequence: Synthetic polypeptide"
  source: /note="N-term Amino group"
  MOD_RES (1)..(1): Pra
  source: /note="C-term Amide"
GYCQKWLWTCDSKRACCEGLECKLWCRKIW

SEQ ID NO: 300 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nva
  source: /note="C-term Amide"
GYCQKWVWTCDSKRACCEGLECKLWCRKIW

SEQ ID NO: 301 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLECKLWCRKIF

SEQ ID NO: 302 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Pra
  source: /note="C-term Amide"
YCQKWLWTCDGKRACCEGLECKLWCRKIW

SEQ ID NO: 303 - protein, 30 aa, Artificial Sequence
  source: /note="Description of Artificial Sequence: Synthetic polypeptide"
  source: /note="N-term Amino group"
  MOD_RES (1)..(1): AzLys
  MOD_RES (7)..(7): Nle
  source: /note="C-term Amide"
KYCQKWLWTCDSKRACCEGLECKLWCRKIW

SEQ ID NO: 304 - protein, 29 aa, Artificial Sequence
  source: /note="Description of Artificial Sequence: Synthetic peptide"
  source: /note="N-term Amino group"
  MOD_RES (1)..(1): AzLys
  MOD_RES (6)..(6): Nle
  source: /note="C-term Amide"
KCQKWLWTCDSKRACCEGLECKLWCRKIW

SEQ ID NO: 305 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): AzLys
  source: /note="C-term Amide"
YCQKWLWTCDKKRACCEGLECKLWCRKIW

SEQ ID NO: 306 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): AzLys
  source: /note="C-term Amide"
YCQKWLWTCDSKRKCCEGLECKLWCRKIW

SEQ ID NO: 307 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): AzLys
  source: /note="C-term Amide"
YCQKWLWTCDSKRACCKGLECKLWCRKIW

SEQ ID NO: 308 - protein, 30 aa, Artificial Sequence
  source: /note="Description of Artificial Sequence: Synthetic polypeptide"
  source: /note="N-term Amino group"
  MOD_RES (1)..(1): Aha
  MOD_RES (7)..(7): Nle
  source: /note="C-term Amide"
AYCQKWLWTCDSKRACCEGLECKLWCRKIW

SEQ ID NO: 309 - protein, 29 aa, Artificial Sequence
  source: /note="Description of Artificial Sequence: Synthetic peptide"
  source: /note="N-term Amino group"
  MOD_RES (1)..(1): Aha
  MOD_RES (6)..(6): Nle
  source: /note="C-term Amide"
ACQKWLWTCDSKRACCEGLECKLWCRKIW

SEQ ID NO: 310 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Aha
  source: /note="C-term Amide"
YCQKWLWTCDAKRACCEGLECKLWCRKIW

SEQ ID NO: 311 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Aha
  source: /note="C-term Amide"
YCQKWLWTCDSKRACCEGLECKLWCRKIW

SEQ ID NO: 312 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Aha
  source: /note="C-term Amide"
YCQKWLWTCDSKRACCAGLECKLWCRKIW

SEQ ID NO: 313 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLECKLWCRKYI

SEQ ID NO: 314 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLECKLWCRKYI

SEQ ID NO: 315 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Pra
  source: /note="C-term Amide"
YCQKWLWTCDGKRACCEGLECKLWCRKYI

SEQ ID NO: 316 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Pra
  source: /note="C-term Amide"
YCQKWLWTCDSKRGCCEGLECKLWCRKYI

SEQ ID NO: 317 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Pra
  source: /note="C-term Amide"
YCQKWLWTCDSKRACCGGLECKLWCRKYI

SEQ ID NO: 318 - protein, 30 aa, Artificial Sequence
  source: /note="Description of Artificial Sequence: Synthetic polypeptide"
  source: /note="N-term Amino group"
  MOD_RES (1)..(1): AzLys
  MOD_RES (7)..(7): Nle
  source: /note="C-term Amide"
KYCQKWLWTCDSKRACCEGLECKLWCRKYI

SEQ ID NO: 319 - protein, 29 aa, Artificial Sequence
  source: /note="Description of Artificial Sequence: Synthetic peptide"
  source: /note="N-term Amino group"
  MOD_RES (1)..(1): AzLys
  MOD_RES (6)..(6): Nle
  source: /note="C-term Amide"
KCQKWLWTCDSKRACCEGLECKLWCRKYI

SEQ ID NO: 320 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): AzLys
  source: /note="C-term Amide"
YCQKWLWTCDKKRACCEGLECKLWCRKYI

SEQ ID NO: 321 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): AzLys
  source: /note="C-term Amide"
YCQKWLWTCDSKRKCCEGLECKLWCRKYI

SEQ ID NO: 322 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): AzLys
  source: /note="C-term Amide"
YCQKWLWTCDSKRACCKGLECKLWCRKYI

SEQ ID NO: 323 - protein, 30 aa, Artificial Sequence
  source: /note="Description of Artificial Sequence: Synthetic polypeptide"
  source: /note="N-term Amino group"
  MOD_RES (1)..(1): Aha
  MOD_RES (7)..(7): Nle
  source: /note="C-term Amide"
AYCQKWLWTCDSKRACCEGLECKLWCRKYI

SEQ ID NO: 324 - protein, 29 aa, Artificial Sequence
  source: /note="Description of Artificial Sequence: Synthetic peptide"
  source: /note="N-term Amino group"
  MOD_RES (1)..(1): Aha
  MOD_RES (6)..(6): Nle
  source: /note="C-term Amide"
ACQKWLWTCDSKRACCEGLECKLWCRKYI

SEQ ID NO: 325 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Aha
  source: /note="C-term Amide"
YCQKWLWTCDAKRACCEGLECKLWCRKYI

SEQ ID NO: 326 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Aha
  source: /note="C-term Amide"
YCQKWLWTCDSKRACCEGLECKLWCRKYI

SEQ ID NO: 327 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Aha
  source: /note="C-term Amide"
YCQKWLWTCDSKRACCAGLECKLWCRKYI

SEQ ID NO: 328 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKEI

SEQ ID NO: 329 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLRCKLWCRKEI

SEQ ID NO: 330 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Pra
  source: /note="C-term Amide"
YCQKWLWTCDGKRACCEGLRCKLWCRKEI

SEQ ID NO: 331 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Pra
  source: /note="C-term Amide"
YCQKWLWTCDSKRGCCEGLRCKLWCRKEI

SEQ ID NO: 332 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Pra
  source: /note="C-term Amide"
YCQKWLWTCDSKRACCGGLRCKLWCRKEI

SEQ ID NO: 333 - protein, 30 aa, Artificial Sequence
  source: /note="Description of Artificial Sequence: Synthetic polypeptide"
  source: /note="N-term Amino group"
  MOD_RES (1)..(1): AzLys
  MOD_RES (7)..(7): Nle
  source: /note="C-term Amide"
KYCQKWLWTCDSKRACCEGLRCKLWCRKEI

SEQ ID NO: 334 - protein, 29 aa, Artificial Sequence
  source: /note="Description of Artificial Sequence: Synthetic peptide"
  source: /note="N-term Amino group"
  MOD_RES (1)..(1): AzLys
  MOD_RES (6)..(6): Nle
  source: /note="C-term Amide"
KCQKWLWTCDSKRACCEGLRCKLWCRKEI

SEQ ID NO: 335 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): AzLys
  source: /note="C-term Amide"
YCQKWLWTCDKKRACCEGLRCKLWCRKEI

SEQ ID NO: 336 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): AzLys
  source: /note="C-term Amide"
YCQKWLWTCDSKRKCCEGLRCKLWCRKEI

SEQ ID NO: 337 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): AzLys
  source: /note="C-term Amide"
YCQKWLWTCDSKRACCKGLRCKLWCRKEI

SEQ ID NO: 338 - protein, 30 aa, Artificial Sequence
  source: /note="Description of Artificial Sequence: Synthetic polypeptide"
  source: /note="N-term Amino group"
  MOD_RES (1)..(1): Aha
  MOD_RES (7)..(7): Nle
  source: /note="C-term Amide"
AYCQKWLWTCDSKRACCEGLRCKLWCRKEI

SEQ ID NO: 339 - protein, 29 aa, Artificial Sequence
  source: /note="Description of Artificial Sequence: Synthetic peptide"
  source: /note="N-term Amino group"
  MOD_RES (1)..(1): Aha
  MOD_RES (6)..(6): Nle
  source: /note="C-term Amide"
ACQKWLWTCDSKRACCEGLRCKLWCRKEI

SEQ ID NO: 340 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Aha
  source: /note="C-term Amide"
YCQKWLWTCDAKRACCEGLRCKLWCRKEI

SEQ ID NO: 341 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Aha
  source: /note="C-term Amide"
YCQKWLWTCDSKRACCEGLRCKLWCRKEI

SEQ ID NO: 342 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Aha
  source: /note="C-term Amide"
YCQKWLWTCDSKRACCAGLRCKLWCRKEI

SEQ ID NO: 343 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLECKLWCRKII

SEQ ID NO: 344 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Pra
  source: /note="C-term Amide"
YCQKWLWTCDGKRACCEGLECKLWCRKII

SEQ ID NO: 345 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Pra
  source: /note="C-term Amide"
YCQKWLWTCDSKRGCCEGLECKLWCRKII

SEQ ID NO: 346 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Pra
  source: /note="C-term Amide"
YCQKWLWTCDSKRACCGGLECKLWCRKII

SEQ ID NO: 347 - protein, 30 aa, Artificial Sequence
  source: /note="Description of Artificial Sequence: Synthetic polypeptide"
  source: /note="N-term Amino group"
  MOD_RES (1)..(1): AzLys
  MOD_RES (7)..(7): Nle
  source: /note="C-term Amide"
KYCQKWLWTCDSKRACCEGLECKLWCRKII

SEQ ID NO: 348 - protein, 29 aa, Artificial Sequence
  source: /note="Description of Artificial Sequence: Synthetic peptide"
  source: /note="N-term Amino group"
  MOD_RES (1)..(1): AzLys
  MOD_RES (6)..(6): Nle
  source: /note="C-term Amide"
KCQKWLWTCDSKRACCEGLECKLWCRKII

SEQ ID NO: 349 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): AzLys
  source: /note="C-term Amide"
YCQKWLWTCDKKRACCEGLECKLWCRKII

SEQ ID NO: 350 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): AzLys
  source: /note="C-term Amide"
YCQKWLWTCDSKRKCCEGLECKLWCRKII

SEQ ID NO: 351 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): AzLys
  source: /note="C-term Amide"
YCQKWLWTCDSKRACCKGLECKLWCRKII

SEQ ID NO: 352 - protein, 30 aa, Artificial Sequence
  source: /note="Description of Artificial Sequence: Synthetic polypeptide"
  source: /note="N-term Amino group"
  MOD_RES (1)..(1): Aha
  MOD_RES (7)..(7): Nle
  source: /note="C-term Amide"
AYCQKWLWTCDSKRACCEGLECKLWCRKII

SEQ ID NO: 353 - protein, 29 aa, Artificial Sequence
  source: /note="Description of Artificial Sequence: Synthetic peptide"
  source: /note="N-term Amino group"
  MOD_RES (1)..(1): Aha
  MOD_RES (6)..(6): Nle
  source: /note="C-term Amide"
ACQKWLWTCDSKRACCEGLECKLWCRKII

SEQ ID NO: 354 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Aha
  source: /note="C-term Amide"
YCQKWLWTCDAKRACCEGLECKLWCRKII

SEQ ID NO: 355 - protein, 29 aa, Artificial Sequence
  source: /note="Description of Artificial Sequence: Synthetic peptide"
  source: /note="N-term Amino group"
  MOD_RES (6)..(6): Nle
  MOD_RES (14)..(14): Aha
  source: /note="C-term Amide"
YCQKWLWTCDSKRACCEGLECKLWCRKII

SEQ ID NO: 356 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Aha
  source: /note="C-term Amide"
YCQKWLWTCDSKRACCAGLECKLWCRKII

SEQ ID NO: 357 - protein, 30 aa, Artificial Sequence; identical to SEQ ID NO: 247
  source: /note="Description of Artificial Sequence: Synthetic polypeptide"
  source: /note="N-term Amino group"
  MOD_RES (7)..(7): Nle
  source: /note="C-term Amide"

SEQ ID NO: 358 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
FYCQKWLWTCDSKRACCEGLRCKLWCRKII

SEQ ID NO: 359 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
GYCQKWLWTCDSKRACCEGLRCKLWCRKII

SEQ ID NO: 360 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
IYCQKWLWTCDSKRACCEGLRCKLWCRKII

SEQ ID NO: 361 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
LYCQKWLWTCDSKRACCEGLRCKLWCRKII

SEQ ID NO: 362 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
PYCQKWLWTCDSKRACCEGLRCKLWCRKII

SEQ ID NO: 363 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
VYCQKWLWTCDSKRACCEGLRCKLWCRKII

SEQ ID NO: 364 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
WYCQKWLWTCDSKRACCEGLRCKLWCRKII

SEQ ID NO: 365 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
YYCQKWLWTCDSKRACCEGLRCKLWCRKII

SEQ ID NO: 366 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): CyA
  MOD_RES (7)..(7): Nle
  source: /note="C-term Amide"

SEQ ID NO: 367 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): AllylG
  MOD_RES (7)..(7): Nle
  source: /note="C-term Amide"

SEQ ID NO: 368 - protein, 30 aa, Artificial Sequence
  source: /note="Description of Artificial Sequence: Synthetic polypeptide"
  source: /note="N-term Amino group"
  MOD_RES (1)..(1): Abu
  MOD_RES (7)..(7): Nle
  source: /note="C-term Amide"
XYCQKWLWTCDSKRACCEGLRCKLWCRKII

SEQ ID NO: 369 - protein, 30 aa, Artificial Sequence; identical to SEQ ID NO: 363
  source: /note="Description of Artificial Sequence: Synthetic polypeptide"
  source: /note="N-term Amino group"
  MOD_RES (1)..(1): Nva
  MOD_RES (7)..(7): Nle
  source: /note="C-term Amide"

SEQ ID NO: 370 - protein, 30 aa, Artificial Sequence; identical to SEQ ID NO: 361
  source: /note="Description of Artificial Sequence: Synthetic polypeptide"
  source: /note="N-term Amino group"
  MOD_RES (1)..(1): Nle
  MOD_RES (7)..(7): Nle
  source: /note="C-term Amide"

SEQ ID NO: 371 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): OctylG
  MOD_RES (7)..(7): Nle
  source: /note="C-term Amide"

SEQ ID NO: 372 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): D-residue
  MOD_RES (7)..(7): Nle
  source: /note="C-term Amide"

SEQ ID NO: 373 - protein, 30 aa, Artificial Sequence; identical to SEQ ID NO: 361
  source: /note="Description of Artificial Sequence: Synthetic polypeptide"
  source: /note="N-term Amino group"
  MOD_RES (1)..(1): D-residue
  MOD_RES (7)..(7): Nle
  source: /note="C-term Amide"

SEQ ID NO: 374 - protein, 30 aa, Artificial Sequence; identical to SEQ ID NO: 358
  source: /note="Description of Artificial Sequence: Synthetic polypeptide"
  source: /note="N-term Amino group"
  MOD_RES (1)..(1): D-residue
  MOD_RES (7)..(7): Nle
  source: /note="C-term Amide"

SEQ ID NO: 375 - protein, 30 aa, Artificial Sequence; identical to SEQ ID NO: 368
  source: /note="Description of Artificial Sequence: Synthetic polypeptide"
  source: /note="N-term Amino group"
  MOD_RES (1)..(1): Sar
  MOD_RES (7)..(7): Nle
  source: /note="C-term Amide"

SEQ ID NO: 376 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): bAla
  MOD_RES (7)..(7): Nle
  source: /note="C-term Amide"

SEQ ID NO: 377 - protein, 30 aa, Artificial Sequence; identical to SEQ ID NO: 361
  source: /note="Description of Artificial Sequence: Synthetic polypeptide"
  source: /note="N-term Amino group"
  MOD_RES (1)..(1): hLeu
  MOD_RES (7)..(7): Nle
  source: /note="C-term Amide"

SEQ ID NO: 378 - protein, 30 aa, Artificial Sequence; identical to SEQ ID NO: 358
  source: /note="Description of Artificial Sequence: Synthetic polypeptide"
  source: /note="N-term Amino group"
  MOD_RES (1)..(1): 4-Cl-Phe
  MOD_RES (7)..(7): Nle
  source: /note="C-term Amide"

SEQ ID NO: 379 - protein, 30 aa, Artificial Sequence; identical to SEQ ID NO: 358
  source: /note="Description of Artificial Sequence: Synthetic polypeptide"
  source: /note="N-term Amino group"
  MOD_RES (1)..(1): hPhe
  MOD_RES (7)..(7): Nle
  source: /note="C-term Amide"

SEQ ID NO: 380 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): KPPG3
  source: /note="C-term Amide"
AYCQKWLWTCDSKRKCCEGLRCKLWCRKII

SEQ ID NO: 381 - protein, 30 aa, Artificial Sequence
  source: /note="Description of Artificial Sequence: Synthetic polypeptide"
  source: /note="N-term Amino group"
  MOD_RES (1)..(1): AllylG
  MOD_RES (7)..(7): Nle
  MOD_RES (15)..(15): KPPG3
  source: /note="C-term Amide"
GYCQKWLWTCDSKRKCCEGLRCKLWCRKII

SEQ ID NO: 382 - protein, 30 aa, Artificial Sequence
  source: /note="Description of Artificial Sequence: Synthetic polypeptide"
  source: /note="N-term Amino group"
  MOD_RES (1)..(1): Abu
  MOD_RES (7)..(7): Nle
  MOD_RES (15)..(15): KPPG3
  source: /note="C-term Amide"
XYCQKWLWTCDSKRKCCEGLRCKLWCRKII

SEQ ID NO: 383 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"
VYCQKWLWTCDSKRKCCEGLRCKLWCRKII

SEQ ID NO: 384 - protein, 30 aa, Artificial Sequence; identical to SEQ ID NO: 381
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (15)..(15): KPPG3
  source: /note="C-term Amide"

SEQ ID NO: 385 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): KPPG3
  source: /note="C-term Amide"
AYCQKWLWTCDSKRACCKGLRCKLWCRKII

SEQ ID NO: 386 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (18)..(18): KPPG3
  source: /note="C-term Amide"
GYCQKWLWTCDSKRACCKGLRCKLWCRKII

SEQ ID NO: 387 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (18)..(18): Pra
  source: /note="C-term Amide"
GYCQKWLWTCDSKRACCGGLRCKLWCRKII

SEQ ID NO: 388 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRKII

SEQ ID NO: 389 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  source: /note="C-term Amide"
AYCQKWLWTCDGKRACCEGLRCKLWCRKII

SEQ ID NO: 390 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (12)..(12): Pra
  source: /note="C-term Amide"
GYCQKWLWTCDGKRACCEGLRCKLWCRKII

SEQ ID NO: 391 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): Pra
  MOD_RES (7)..(7): Nle
  source: /note="C-term Amide"
AGCQKWLWTCDSKRACCEGLRCKLWCRKII

SEQ ID NO: 392 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"
AYCQKWLWTCDSKRKCCEGLRCKLWCRKEI

SEQ ID NO: 393 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"
AYCQKWLWTCDSKRKCCEGLECKLWCRKII

SEQ ID NO: 394 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"
AYCQKWLWTCDSKRKCCEGLECKLWCRKYI

SEQ ID NO: 395 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRKEI

SEQ ID NO: 396 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLECKLWCRKII

SEQ ID NO: 397 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLECKLWCRKYI

SEQ ID NO: 398 - protein, 30 aa, Artificial Sequence; identical to SEQ ID NO: 380
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"

SEQ ID NO: 399 - protein, 30 aa, Artificial Sequence; identical to SEQ ID NO: 381
  source: /note="Description of Artificial Sequence: Synthetic polypeptide"
  source: /note="N-term Amino group"
  MOD_RES (1)..(1): AllylG
  MOD_RES (7)..(7): Nle
  MOD_RES (15)..(15): Lys(Pra)
  source: /note="C-term Amide"

SEQ ID NO: 400 - protein, 30 aa, Artificial Sequence; identical to SEQ ID NO: 382
  source: /note="Description of Artificial Sequence: Synthetic polypeptide"
  source: /note="N-term Amino group"
  MOD_RES (1)..(1): Abu
  MOD_RES (7)..(7): Nle
  MOD_RES (15)..(15): Lys(Pra)
  source: /note="C-term Amide"

SEQ ID NO: 401 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 402 - protein, 30 aa, Artificial Sequence; identical to SEQ ID NO: 387
  source: /note="Description of Artificial Sequence: Synthetic polypeptide"
  source: /note="N-term Amino group"
  MOD_RES (1)..(1): AllylG
  MOD_RES (7)..(7): Nle
  MOD_RES (18)..(18): Pra
  source: /note="C-term Amide"

SEQ ID NO: 403 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (18)..(18): Pra
  source: /note="C-term Amide"
VYCQKWLWTCDSKRACCGGLRCKLWCRKII

SEQ ID NO: 404 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 405 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"

SEQ ID NO: 406 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Atz(PEG10)
  source: /note="C-term Amide"
YCQKWLWTCDSKRACCAGLRCKLWCRKEI

SEQ ID NO: 407 - protein, 29 aa, Artificial Sequence
  source: /note="Description of Artificial Sequence: Synthetic peptide"
  source: /note="N-term Amino group"
  MOD_RES (1)..(1): Atz(PEG10)
  MOD_RES (6)..(6): Nle
  source: /note="C-term Amide"
ACQKWLWTCDSKRACCEGLECKLWCRKII

SEQ ID NO: 408 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Atz(PEG10)
  source: /note="C-term Amide"
YCQKWLWTCDAKRACCEGLECKLWCRKII

SEQ ID NO: 409 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Atz(PEG10)
  source: /note="C-term Amide"
YCQKWLWTCDSKRACCAGLECKLWCRKII

SEQ ID NO: 410 - protein, 30 aa, Artificial Sequence; identical to SEQ ID NO: 380
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): KAP3P10
  source: /note="C-term Amide"

SEQ ID NO: 411 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"
VYCQKWLWTCDSKRKCCEGLRCKLWCRKEI

SEQ ID NO: 412 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 413 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"
VYCQKWLWTCDSKRKCCEGLECKLWCRKYI

SEQ ID NO: 414 - protein, 30 aa, Artificial Sequence; identical to SEQ ID NO: 413
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 415 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"

SEQ ID NO: 416 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (15)..(15): KPPG3
  source: /note="C-term Amide"

SEQ ID NO: 417 - protein, 30 aa, Artificial Sequence; identical to SEQ ID NO: 413
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"

SEQ ID NO: 418 - protein, 30 aa, Artificial Sequence; identical to SEQ ID NO: 413
  source: /note="Description of Artificial Sequence: Synthetic polypeptide"
  source: /note="N-term Amino group"
  MOD_RES (1)..(1): Nva
  MOD_RES (15)..(15): KPPG3
  source: /note="C-term Amide"

SEQ ID NO: 419 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"
VYCQKWLWTCDSKRKCCEGLECKLWCRKIW

SEQ ID NO: 420 - protein, 30 aa, Artificial Sequence; identical to SEQ ID NO: 419
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 421 - protein, 30 aa, Artificial Sequence; identical to SEQ ID NO: 419
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"

SEQ ID NO: 422 - protein, 30 aa, Artificial Sequence; identical to SEQ ID NO: 419
  source: /note="Description of Artificial Sequence: Synthetic polypeptide"
  source: /note="N-term Amino group"
  MOD_RES (1)..(1): Nva
  MOD_RES (15)..(15): KPPG3
  source: /note="C-term Amide"

SEQ ID NO: 423 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 424 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (15)..(15): KPPG3
  source: /note="C-term Amide"

SEQ ID NO: 425 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 426 - protein, 30 aa, Artificial Sequence; identical to SEQ ID NO: 299
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 427 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): Atz(PEG11-benzylthioacetamide)
  MOD_RES (7)..(7): Nle
  source: /note="C-term Amide"

SEQ ID NO: 428-429 - skipped (2 entries)

SEQ ID NO: 430 - protein, 29 aa, Chilobrachys jingzhao
YCQKWMWTCDSERKCCEGYVCELWCKYNM

SEQ ID NO: 431 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 432 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KPPG3
  source: /note="C-term Amide"

SEQ ID NO: 433 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KAtzNP10
  source: /note="C-term Amide"

SEQ ID NO: 434 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): KAP4P10
  source: /note="C-term Amide"

SEQ ID NO: 435 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 436 - protein, 30 aa, Artificial Sequence; identical to SEQ ID NO: 413
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 437 - protein, 30 aa, Artificial Sequence; identical to SEQ ID NO: 419
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Pra)
  source: /note="C-term Amide"

SEQ ID NO: 438 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 439 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 440 - protein, 30 aa, Artificial Sequence; identical to SEQ ID NO: 413
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 441 - protein, 30 aa, Artificial Sequence; identical to SEQ ID NO: 419
  source: /note="Description of Artificial Sequence: Synthetic polypeptide"
  source: /note="N-term Amino group"
  MOD_RES (1)..(1): Nva
  MOD_RES (15)..(15): Lys(Pra)
  source: /note="C-term Amide"

SEQ ID NO: 442 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (15)..(15): Lys(Pra-NPEG4)
  source: /note="C-term Amide"

SEQ ID NO: 443 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz(NPEG10)
  source: /note="C-term Amide"
AYCQKWLWTCDSKRACCAGLRCKLWCRKEI

SEQ ID NO: 444 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Atz(NPEG10))
  source: /note="C-term Amide"

SEQ ID NO: 445 - protein, 30 aa, Artificial Sequence; identical to SEQ ID NO: 394
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Atz(NPEG10))
  source: /note="C-term Amide"

SEQ ID NO: 446 - protein, 30 aa, Artificial Sequence; identical to SEQ ID NO: 383
  source: /note="Description of Artificial Sequence: Synthetic polypeptide"
  source: /note="N-term Amino group"
  MOD_RES (1)..(1): Nva
  MOD_RES (15)..(15): Lys(Atz(NPEG10))
  source: /note="C-term Amide"

SEQ ID NO: 447 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (15)..(15): Lys(Atz(NPEG10))
  source: /note="C-term Amide"

SEQ ID NO: 448 - protein, 30 aa, Artificial Sequence; identical to SEQ ID NO: 411
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (15)..(15): Lys(Atz(NPEG10))
  source: /note="C-term Amide"

SEQ ID NO: 449 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (15)..(15): Lys(Pra)
  source: /note="C-term Amide"

SEQ ID NO: 450 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKEW

SEQ ID NO: 451 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"
AYCQKWLWTCDSKRKCCEGLRCKLWCRKEW

SEQ ID NO: 452 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRKEW

SEQ ID NO: 453 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Pra)
  source: /note="C-term Amide"
AYCQKWLWTCDSKRKCCEGLRCKLWCRKIW

SEQ ID NO: 454 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRKIW

SEQ ID NO: 455 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"

SEQ ID NO: 456 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCQKWLWTCDSKRACCKGLRCKLWCRKEI

SEQ ID NO: 457 - protein, 30 aa, Artificial Sequence; identical to SEQ ID NO: 333
  source: /note="Description of Artificial Sequence: Synthetic polypeptide"
  source: /note="N-term Amino group"
  MOD_RES (1)..(1): Lys(NPeg11)
  MOD_RES (7)..(7): Nle
  source: /note="C-term Amide"

SEQ ID NO: 458 - protein, 30 aa, Artificial Sequence; identical to SEQ ID NO: 451
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"

SEQ ID NO: 459 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCQKWLWTCDSKRACCKGLRCKLWCRKEW

SEQ ID NO: 460 - protein, 30 aa, Artificial Sequence
  source: /note="Description of Artificial Sequence: Synthetic polypeptide"
  source: /note="N-term Amino group"
  MOD_RES (1)..(1): Lys(NPeg11)
  MOD_RES (7)..(7): Nle
  source: /note="C-term Amide"
KYCQKWLWTCDSKRACCEGLRCKLWCRKEW

SEQ ID NO: 461 - protein, 30 aa, Artificial Sequence
  source: /note="Description of Artificial Sequence: Synthetic polypeptide"
  source: /note="N-term Amino group"
  MOD_RES (7)..(7): Nle
  MOD_RES (15)..(15): Lys(NPeg11)
  source: /note="C-term Amide"
LYCQKWLWTCDSKRKCCEGLRCKLWCRKEI

SEQ ID NO: 462 - protein, 30 aa, Artificial Sequence
  source: /note="Description of Artificial Sequence: Synthetic polypeptide"
  source: /note="N-term Amino group"
  MOD_RES (7)..(7): Nle
  MOD_RES (18)..(18): Lys(NPeg11)
  source: /note="C-term Amide"
LYCQKWLWTCDSKRACCKGLRCKLWCRKEI

SEQ ID NO: 463 - protein, 30 aa, Artificial Sequence; identical to SEQ ID NO: 461
  source: /note="Description of Artificial Sequence: Synthetic polypeptide"
  source: /note="N-term Amino group"
  MOD_RES (1)..(1): D-residue
  MOD_RES (7)..(7): Nle
  MOD_RES (15)..(15): Lys(NPeg11)
  source: /note="C-term Amide"

SEQ ID NO: 464 - protein, 30 aa, Artificial Sequence; identical to SEQ ID NO: 462
  source: /note="Description of Artificial Sequence: Synthetic polypeptide"
  source: /note="N-term Amino group"
  MOD_RES (1)..(1): D-residue
  MOD_RES (7)..(7): Nle
  MOD_RES (18)..(18): Lys(NPeg11)
  source: /note="C-term Amide"

SEQ ID NO: 465 - protein, 30 aa, Artificial Sequence; identical to SEQ ID NO: 461
  source: /note="Description of Artificial Sequence: Synthetic polypeptide"
  source: /note="N-term Amino group"
  MOD_RES (1)..(1): NMeLeu
  MOD_RES (7)..(7): Nle
  MOD_RES (15)..(15): Lys(NPeg11)
  source: /note="C-term Amide"

SEQ ID NO: 466 - protein, 30 aa, Artificial Sequence; identical to SEQ ID NO: 462
  source: /note="Description of Artificial Sequence: Synthetic polypeptide"
  source: /note="N-term Amino group"
  MOD_RES (1)..(1): NMeLeu
  MOD_RES (7)..(7): Nle
  MOD_RES (18)..(18): Lys(NPeg11)
  source: /note="C-term Amide"

SEQ ID NO: 467 - protein, 30 aa, Artificial Sequence
  source: /note="Description of Artificial Sequence: Synthetic polypeptide"
  source: /note="N-term Amino group"
  MOD_RES (1)..(1): 1-Ach
  MOD_RES (7)..(7): Nle
  MOD_RES (15)..(15): Lys(NPeg11)
  source: /note="C-term Amide"
XYCQKWLWTCDSKRKCCEGLRCKLWCRKEI

SEQ ID NO: 468 - protein, 30 aa, Artificial Sequence
  source: /note="Description of Artificial Sequence: Synthetic polypeptide"
  source: /note="N-term Amino group"
  MOD_RES (1)..(1): 1-Ach
  MOD_RES (7)..(7): Nle
  MOD_RES (18)..(18): Lys(NPeg11)
  source: /note="C-term Amide"
XYCQKWLWTCDSKRACCKGLRCKLWCRKEI

SEQ ID NO: 469 - protein, 31 aa, Artificial Sequence
  source: /note="Description of Artificial Sequence: Synthetic polypeptide"
  source: /note="N-term Amino group"
  MOD_RES (2)..(2): Lys(NPeg11)
  MOD_RES (8)..(8): Nle
  source: /note="C-term Amide"
LKYCQKWLWTCDSKRACCEGLRCKLWCRKEI

SEQ ID NO: 470 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (16)..(16): Lys(NPeg11)
  source: /note="C-term Amide"
LVYCQKWLWTCDSKRKCCEGLRCKLWCRKEI

SEQ ID NO: 471 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Lys(NPeg11)
  source: /note="C-term Amide"
LVYCQKWLWTCDSKRACCKGLRCKLWCRKEI

SEQ ID NO: 472 - protein, 31 aa, Artificial Sequence; identical to SEQ ID NO: 470
  source: /note="Description of Artificial Sequence: Synthetic polypeptide"
  source: /note="N-term Amino group"
  MOD_RES (1)..(1): D-residue
  MOD_RES (2)..(2): Nva
  MOD_RES (8)..(8): Nle
  MOD_RES (16)..(16): Lys(NPeg11)
  source: /note="C-term Amide"

SEQ ID NO: 473 - protein, 31 aa, Artificial Sequence; identical to SEQ ID NO: 471
  source: /note="Description of Artificial Sequence: Synthetic polypeptide"
  source: /note="N-term Amino group"
  MOD_RES (1)..(1): D-residue
  MOD_RES (2)..(2): Nva
  MOD_RES (8)..(8): Nle
  MOD_RES (19)..(19): Lys(NPeg11)
  source: /note="C-term Amide"

SEQ ID NO: 474 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (16)..(16): Lys(NPeg11)
  source: /note="C-term Amide"
FVYCQKWLWTCDSKRKCCEGLRCKLWCRKEI

SEQ ID NO: 475 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Lys(NPeg11)
  source: /note="C-term Amide"
FVYCQKWLWTCDSKRACCKGLRCKLWCRKEI

SEQ ID NO: 476 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (21)..(21): Lys(NPeg11)
  source: /note="C-term Amide"
AYCQKWLWTCDSKRACCEGLKCKLWCRKIW

SEQ ID NO: 477 - protein, 20 aa, Artificial Sequence
  source: /note="Description of Artificial Sequence: Synthetic peptide"
GGGGSGGGGSGGGGSGGGGS

SEQ ID NO: 478 - protein, 246 aa, Artificial Sequence
  source: /note="Description of Artificial Sequence: Synthetic polypeptide"
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXNXXG

SEQ ID NO: 480 - protein, 4 aa, Artificial Sequence
  source: /note="Description of Artificial Sequence: Synthetic peptide"
GGGG

SEQ ID NO: 481 - protein, 5 aa, Artificial Sequence
  source: /note="Description of Artificial Sequence: Synthetic peptide"
GGGGG

SEQ ID NO: 482 - protein, 7 aa, Artificial Sequence
  source: /note="Description of Artificial Sequence: Synthetic peptide"
GGGGGGG

SEQ ID NO: 483 - protein, 15 aa, Artificial Sequence
  source: /note="Description of Artificial Sequence: Synthetic peptide"
GGGGSGGGGSGGGGS

SEQ ID NO: 484 - protein, 6 aa, Artificial Sequence
  source: /note="Description of Artificial Sequence: Synthetic peptide"
GGGGGK

SEQ ID NO: 485 - protein, 7 aa, Artificial Sequence
  source: /note="Description of Artificial Sequence: Synthetic peptide"
GGGGGKR

SEQ ID NO: 486 - protein, 8 aa, Artificial Sequence
  source: /note="Description of Artificial Sequence: Synthetic peptide"
GGGKGGGG

SEQ ID NO: 487 - protein, 8 aa, Artificial Sequence
  source: /note="Description of Artificial Sequence: Synthetic peptide"
GGGNGSGG

SEQ ID NO: 488 - protein, 8 aa, Artificial Sequence
  source: /note="Description of Artificial Sequence: Synthetic peptide"
GGGCGGGG

SEQ ID NO: 489 - protein, 5 aa, Artificial Sequence
  source: /note="Description of Artificial Sequence: Synthetic peptide"
GPNGG

SEQ ID NO: 490 - protein, 8 aa, Artificial Sequence
  source: /note="Description of Artificial Sequence: Synthetic peptide"
GGGKGGGG

SEQ ID NO: 491 - protein, 5 aa, Artificial Sequence
  source: /note="Description of Artificial Sequence: Synthetic peptide"
GGGGS

SEQ ID NO: 492 - protein, 10 aa, Artificial Sequence
  source: /note="Description of Artificial Sequence: Synthetic peptide"
GGGGSGGGGS

SEQ ID NO: 493 - protein, 25 aa, Artificial Sequence
  source: /note="Description of Artificial Sequence: Synthetic peptide"
GGGGSGGGGSGGGGSGGGGSGGGGS

SEQ ID NO: 494 - protein, 6 aa, Artificial Sequence
  source: /note="Description of Artificial Sequence: Synthetic peptide"
GGEGGG

SEQ ID NO: 495 - protein, 8 aa, Artificial Sequence
  source: /note="Description of Artificial Sequence: Synthetic peptide"
GGEEEGGG

SEQ ID NO: 496 - protein, 5 aa, Artificial Sequence
  source: /note="Description of Artificial Sequence: Synthetic peptide"
GEEEG

SEQ ID NO: 497 - protein, 4 aa, Artificial Sequence
  source: /note="Description of Artificial Sequence: Synthetic peptide"
GEEE

SEQ ID NO: 498 - protein, 6 aa, Artificial Sequence
  source: /note="Description of Artificial Sequence: Synthetic peptide"
GGDGGG

SEQ ID NO: 499 - protein, 7 aa, Artificial Sequence
  source: /note="Description of Artificial Sequence: Synthetic peptide"
GGDDDGG

SEQ ID NO: 500 - protein, 5 aa, Artificial Sequence
  source: /note="Description of Artificial Sequence: Synthetic peptide"
GDDDG

SEQ ID NO: 501 - protein, 4 aa, Artificial Sequence
  source: /note="Description of Artificial Sequence: Synthetic peptide"
GDDD

SEQ ID NO: 502 - protein, 21 aa, Artificial Sequence
  source: /note="Description of Artificial Sequence: Synthetic peptide"
GGGGSDDSDEGSDGEDGGGGS

SEQ ID NO: 503 - protein, 5 aa, Artificial Sequence
  source: /note="Description of Artificial Sequence: Synthetic peptide"
WEWEW

SEQ ID NO: 504 - protein, 5 aa, Artificial Sequence
  source: /note="Description of Artificial Sequence: Synthetic peptide"
FEFEF

SEQ ID NO: 505 - protein, 6 aa, Artificial Sequence
  source: /note="Description of Artificial Sequence: Synthetic peptide"
EEEWWW

SEQ ID NO: 506 - protein, 6 aa, Artificial Sequence
  source: /note="Description of Artificial Sequence: Synthetic peptide"
EEEFFF

SEQ ID NO: 507 - protein, 7 aa, Artificial Sequence
  source: /note="Description of Artificial Sequence: Synthetic peptide"
WWEEEWW

SEQ ID NO: 508 - protein, 7 aa, Artificial Sequence
  source: /note="Description of Artificial Sequence: Synthetic peptide"
FFEEEFF

SEQ ID NO: 509 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXYXXG

SEQ ID NO: 510 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXSXXG

SEQ ID NO: 511 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXTXXG

SEQ ID NO: 512 - protein, 22 aa, Artificial Sequence
  source: /note="Description of Artificial Sequence: Synthetic peptide"
GSGSATGGSGSTASSGSGSATH

SEQ ID NO: 513 - protein, 22 aa, Artificial Sequence
  source: /note="Description of Artificial Sequence: Synthetic peptide"
HGSGSATGGSGSTASSGSGSAT

SEQ ID NO: 514 - protein, 19 aa, Artificial Sequence
  source: /note="Description of Artificial Sequence: Synthetic peptide"
AEAAAKEAAAKEAAAKAGG

SEQ ID NO: 515 - protein, 5 aa, Artificial Sequence
  source: /note="Description of Artificial Sequence: Synthetic peptide"
  MOD_RES (2)..(4): Any amino acid
KXXXD

SEQ ID NO: 516 - protein, 34 aa, Artificial Sequence
  Synthetic polypeptide
  MISC_FEATURE (1)..(2): absent or any amino acid residue
  MISC_FEATURE (3)..(3): any amino acid residue
  MISC_FEATURE (4)..(4): Cys if Xaa18 is Cys; or SeCys if Xaa18 is SeCys
  MISC_FEATURE (5)..(5): any neutral hydrophilic or basic amino acid residue
  MISC_FEATURE (6)..(6): Any basic amino acid residue
  MISC_FEATURE (7)..(7): Trp, 5-bromoTrp, 6-bromoTrp, 5-chloroTrp, 6-chloroTrp, 1-Nal, 2-Nal, or thioTrp residue
  MISC_FEATURE (8)..(8): Met, Nle, Nva, Leu, Ile, Val, or Phe residue
  MISC_FEATURE (9)..(9): Trp, 5-bromoTrp, 6-bromoTrp, 5-chloroTrp, 6-chloroTrp, 1-Nal, 2-Nal, or thioTrp residue
  MISC_FEATURE (10)..(10): basic or neutral hydrophilic amino acid residue, or an Ala residue
  MISC_FEATURE (11)..(11): Cys if Xaa23 is Cys; or SeCys if Xaa23 is SeCys
  MISC_FEATURE (13)..(13): any amino acid residue except a hydrophobic residue
  MISC_FEATURE (14)..(14): basic residue or an Ala residue
  MISC_FEATURE (16)..(16): any amino acid residue
  MISC_FEATURE (17)..(17): Cys is Xaa27 is Cys; or SeCys if Xaa27 is SeCys
  MISC_FEATURE (18)..(18): Cys or SeCys
  MISC_FEATURE (19)..(19): any amino acid residue
  MISC_FEATURE (20)..(20): Gly or Ala residue
  MISC_FEATURE (22)..(22): an acidic, basic amino acid residue, or Ala residue
  MISC_FEATURE (23)..(23): Cys or SeCys residue
  MISC_FEATURE (24)..(24): basic amino acid or Ala residue
  MISC_FEATURE (26)..(26): Trp, 5-bromoTrp, 6-bromoTrp, 5-chloroTrp, 6-chloroTrp, 1-Nal, 2-Nal, or thioTrp residue
  MISC_FEATURE (27)..(27): Cys or SeCys residue
  MISC_FEATURE (28)..(29): basic amino acid residue
  MISC_FEATURE (30)..(30): Ile, Trp, Tyr, 5-bromoTrp, 6-bromoTrp, 5-chloroTrp, 6-chloroTrp, 1-Nal, 2-Nal, thioTrp, 1-Nal, or 2-Nal residue, if Xaa22 is an acidic amino acid residue; or an acidic amino acid residue, if Xaa22 is a basic amino acid residue or an Ala residue
  MISC_FEATURE (31)..(31): Ile, Trp, Tyr, 5-bromoTrp, 6-bromoTrp, 5-chloroTrp, 6-chloroTrp, 1-Nal, 2-Nal, thioTrp, 1-Nal, or 2-Nal residue
  MISC_FEATURE (32)..(34): independently absent or is independently a hydrophobic amino acid residue
XXXXXXXXXXXDXXRXXXXXLXXXLXXXXXXXXX

SEQ ID NO: 517 - protein, 34 aa, Artificial Sequence; identical to SEQ ID NO: 516
  Synthetic polypeptide
  MISC_FEATURE (1)..(1): absent or any amino acid residue
  MISC_FEATURE (2)..(2): any hydrophobic amino acid residue, or a Pra, Aha, Abu, Nva, Nle, Sar, hLeu, hPhe, D-Leu, D-Phe, D-Ala, bAla, AllylG, CyA, or Atz residue
  MISC_FEATURE (3)..(3): any amino acid residue
  MISC_FEATURE (4)..(4): Cys if Xaa18 is Cys; or SeCys if Xaa18 is SeCys
  MISC_FEATURE (5)..(5): any neutral hydrophilic or basic amino acid residue
  MISC_FEATURE (6)..(6): any basic amino acid residue
  MISC_FEATURE (7)..(7): Trp, 5-bromoTrp, 6-bromoTrp, 5-chloroTrp, 6-chloroTrp, 1-Nal, 2-Nal, or thioTrp residue
  MISC_FEATURE (8)..(8): Leu or Nle residue
  MISC_FEATURE (9)..(9): Trp, 5-bromoTrp, 6-bromoTrp, 5-chloroTrp, 6-chloroTrp, 1-Nal, 2-Nal, or thioTrp residue
  MISC_FEATURE (10)..(10): basic or neutral hydrophilic amino acid residue, or an Ala residue
  MISC_FEATURE (11)..(11): Cys if Xaa23 is Cys; or SeCys if Xaa23 is SeCys
  MISC_FEATURE (13)..(13): any amino acid residue except a hydrophobic residue
  MISC_FEATURE (14)..(14): basic residue or an Ala residue
  MISC_FEATURE (16)..(16): any amino acid residue
  MISC_FEATURE (17)..(17): Cys is Xaa27 is Cys; or SeCys if Xaa27 is SeCys
  MISC_FEATURE (18)..(18): Cys or SeCys
  MISC_FEATURE (19)..(19): any amino acid residue
  MISC_FEATURE (20)..(20): Gly or Ala residue
  MISC_FEATURE (22)..(22): basic amino acid residue or Ala residue
  MISC_FEATURE (23)..(23): Cys or SeCys residue
  MISC_FEATURE (24)..(24): basic amino acid residue or Ala residue
  MISC_FEATURE (26)..(26): Trp, 5-bromoTrp, 6-bromoTrp, 5-chloroTrp, 6-chloroTrp, 1-Nal, 2-Nal, or thioTrp residue
  MISC_FEATURE (27)..(27): Cys or SeCys residue
  MISC_FEATURE (28)..(29): basic amino acid residue
  MISC_FEATURE (30)..(31): Ile, Trp, Tyr, 5-bromoTrp, 6-bromoTrp, 5-chloroTrp, 6-chloroTrp, 1-Nal, 2-Nal, thioTrp, 1-Nal, or 2-Nal residue
  MISC_FEATURE (32)..(34): independently absent or is independently a hydrophobic amino acid residue

SEQ ID NO: 518 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): Pra
  MOD_RES (7)..(7): Nle
  source: /note="C-term Amide"
AGCQKWLWTCDSKRACCEGLRCKLWCRKEI

SEQ ID NO: 519 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (11)..(11): Pra
  source: /note="C-term Amide"
AYCQKWLWTCGSKRACCEGLRCKLWCRKEI

SEQ ID NO: 520 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  source: /note="C-term Amide"
AYCQKWLWTCDGKRACCEGLRCKLWCRKEI

SEQ ID NO: 521 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Pra
  source: /note="C-term Amide"
AYCQKWLWTCDSGRACCEGLRCKLWCRKEI

SEQ ID NO: 522 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (14)..(14): Pra
  source: /note="C-term Amide"
AYCQKWLWTCDSKGACCEGLRCKLWCRKEI

SEQ ID NO: 523 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (19)..(19): Pra
  source: /note="C-term Amide"

SEQ ID NO: 524 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (20)..(20): Pra
  source: /note="C-term Amide"
AYCQKWLWTCDSKRACCEGGRCKLWCRKEI

SEQ ID NO: 525 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (21)..(21): Pra
  source: /note="C-term Amide"
AYCQKWLWTCDSKRACCEGLGCKLWCRKEI

SEQ ID NO: 526 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): Pra
  MOD_RES (7)..(7): Nle
  source: /note="C-term Amide"
AGCQKWLWTCDSKRACCEGLRCKLWCRKEW

SEQ ID NO: 527 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (11)..(11): Pra
  source: /note="C-term Amide"
AYCQKWLWTCGSKRACCEGLRCKLWCRKEW

SEQ ID NO: 528 - protein, 35 aa, Ornithoctonus huwena
  source: /note="C-term Amide"
ECLEIFKACNPSNDQCCKSSKLVCSRKTRWCKYQI

SEQ ID NO: 529 - protein, 33 aa, Ornithoctonus huwena
ACKGVFDACTPGKNECCPNRVCSDKHKWCKWKL

SEQ ID NO: 530 - protein, 16 aa, Conus kinoshitai
  source: /note="C-term Amide"
CCNCSSKWCRDHSRCC

SEQ ID NO: 531 - protein, 30 aa, Thrixopelma pruriens
YCQKWMWTCDSERKCCEGMVCRLWCKKKLW

SEQ ID NO: 532 - protein, 34 aa, Grammostola porteri
  source: /note="C-term Amide"
DCLGFMRKCIPDNDKCCRPNLVCSRTHKWCKYVF

SEQ ID NO: 533 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 534 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 535 - protein, 330 aa, Homo sapiens [sequence omitted]

SEQ ID NO: 536 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 539 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 540 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 541 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 542 - protein, 448 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNFNYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 214 aa, Artificial Sequence
  source: /note="Description of Artificial Sequence: Synthetic polypeptide"
DIQMTQSPSSVSASVGDRVTITCRASQGISRRLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 544 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPCVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (21)..(21): Lys(NPeg11)
  source: /note="C-term Amide"
AYCQKWLWTCDSKRACCEGLKCKLWCRKII

SEQ ID NO: 546 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"
AYCQKWLWVCDSKRKCCEGLRCKLWCRKEI

SEQ ID NO: 547 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCQKWLWVCDSKRACCKGLRCKLWCRKEI

SEQ ID NO: 548 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"
AYCLKWLWTCDSKRKCCEGLRCKLWCRKEI

SEQ ID NO: 549 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCLKWLWTCDSKRACCKGLRCKLWCRKEI

SEQ ID NO: 550 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"
AFCQKWLWTCDSKRKCCEGLRCKLWCRKEI

SEQ ID NO: 551 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AFCQKWLWTCDSKRACCKGLRCKLWCRKEI

SEQ ID NO: 552 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (5)..(5): Nle
  MOD_RES (7)..(7): Nle
  MOD_RES (15)..(15): Lys(NPeg11)
  source: /note="C-term Amide"
AYCQLWLWTCDSKRKCCEGLRCKLWCRKEI

SEQ ID NO: 553 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (5)..(5): Nle
  MOD_RES (7)..(7): Nle
  MOD_RES (18)..(18): Lys(NPeg11)
  source: /note="C-term Amide"
AYCQLWLWTCDSKRACCKGLRCKLWCRKEI

SEQ ID NO: 554 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  MOD_RES (23)..(23): Nle
  source: /note="C-term Amide"
AYCQKWLWTCDSKRKCCEGLRCLLWCRKEI

SEQ ID NO: 555 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  MOD_RES (23)..(23): Nle
  source: /note="C-term Amide"
AYCQKWLWTCDSKRACCKGLRCLLWCRKEI

SEQ ID NO: 556 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  MOD_RES (28)..(28): Nle
  source: /note="C-term Amide"
AYCQKWLWTCDSKRKCCEGLRCKLWCRLEI

SEQ ID NO: 557 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  MOD_RES (28)..(28): Nle
  source: /note="C-term Amide"
AYCQKWLWTCDSKRACCKGLRCKLWCRLEI

SEQ ID NO: 558 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(NPeg11)
  source: /note="C-term Amide"
AYCQKWLWTCDSKRKCCEGLRCKLWCKKEI

SEQ ID NO: 559 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCQKWLWTCDSKRACCKGLRCKLWCKKEI

SEQ ID NO: 560 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Nle
  MOD_RES (15)..(15): Lys(NPeg11)
  source: /note="C-term Amide"
AYCQKWLWTCDSLRKCCEGLRCKLWCRKEI

SEQ ID NO: 561 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Nle
  MOD_RES (18)..(18): Lys(NPeg11)
  source: /note="C-term Amide"
AYCQKWLWTCDSLRACCKGLRCKLWCRKEI

SEQ ID NO: 562 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Lys(NPeg11)
  source: /note="C-term Amide"
AYCQKWLWTCDSKRFCCKGLRCKLWCRKEI

SEQ ID NO: 563 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): Lys(NPeg11)
  MOD_RES (7)..(7): Nle
  source: /note="C-term Amide"
AKCQKWLWTCDSKRACCEGLRCKLWCRKEI

SEQ ID NO: 564 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (11)..(11): Lys(NPeg11)
  source: /note="C-term Amide"
AYCQKWLWTCKSKRACCEGLRCKLWCRKEI

SEQ ID NO: 565 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Lys(NPeg11)
  source: /note="C-term Amide"
AYCQKWLWTCDKKRACCEGLRCKLWCRKEI

SEQ ID NO: 566 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Lys(NPeg11)
  source: /note="C-term Amide"

SEQ ID NO: 567 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (14)..(14): Lys(NPeg11)
  source: /note="C-term Amide"
AYCQKWLWTCDSKKACCEGLRCKLWCRKEI

SEQ ID NO: 568 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (19)..(19): Lys(NPeg11)
  source: /note="C-term Amide"
AYCQKWLWTCDSKRACCEKLRCKLWCRKEI

SEQ ID NO: 569 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (20)..(20): Lys(NPeg11)
  source: /note="C-term Amide"
AYCQKWLWTCDSKRACCEGKRCKLWCRKEI

SEQ ID NO: 570 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (21)..(21): Lys(NPeg11)
  source: /note="C-term Amide"
AYCQKWLWTCDSKRACCEGLKCKLWCRKEI

SEQ ID NO: 571 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): Atz
  MOD_RES (7)..(7): Nle
  source: /note="C-term Amide"

SEQ ID NO: 572 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): Atz
  MOD_RES (7)..(7): Nle
  source: /note="C-term Amide"

SEQ ID NO: 573 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  source: /note="C-term Amide"
AYCQKWLWTCDGKRACCEGLRCKLWCRKEW

SEQ ID NO: 574 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Pra
  source: /note="C-term Amide"
AYCQKWLWTCDSGRACCEGLRCKLWCRKEW

SEQ ID NO: 575 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (14)..(14): Pra
  source: /note="C-term Amide"
AYCQKWLWTCDSKGACCEGLRCKLWCRKEW

SEQ ID NO: 576 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (19)..(19): Pra
  source: /note="C-term Amide"
AYCQKWLWTCDSKRACCEGLRCKLWCRKEW

SEQ ID NO: 577 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (20)..(20): Pra
  source: /note="C-term Amide"
AYCQKWLWTCDSKRACCEGGRCKLWCRKEW

SEQ ID NO: 578 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (21)..(21): Pra
  source: /note="C-term Amide"
AYCQKWLWTCDSKRACCEGLGCKLWCRKEW

SEQ ID NO: 579 - protein, 30 aa, Artificial Sequence; identical to SEQ ID NO: 391
  source: /note="Description of Artificial Sequence: Synthetic polypeptide"
  source: /note="N-term Amino group"
  MOD_RES (1)..(1): CyA
  MOD_RES (2)..(2): Pra
  MOD_RES (7)..(7): Nle
  source: /note="C-term Amide"

SEQ ID NO: 580 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (2)..(2): Pra
  MOD_RES (7)..(7): Nle
  source: /note="C-term Amide"
VGCQKWLWTCDSKRACCEGLRCKLWCRKII

SEQ ID NO: 581 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
LGCQKWLWTCDSKRACCEGLRCKLWCRKII

SEQ ID NO: 582 - protein, 30 aa, Artificial Sequence; identical to SEQ ID NO: 581
  source: /note="Description of Artificial Sequence: Synthetic polypeptide"
  source: /note="N-term Amino group"
  MOD_RES (1)..(1): D-residue
  MOD_RES (2)..(2): Pra
  MOD_RES (7)..(7): Nle
  source: /note="C-term Amide"

SEQ ID NO: 583 - protein, 31 aa, Artificial Sequence
  source: /note="Description of Artificial Sequence: Synthetic polypeptide"
  source: /note="N-term Amino group"
  MOD_RES (3)..(3): Pra
  MOD_RES (8)..(8): Nle
  source: /note="C-term Amide"
LLGCQKWLWTCDSKRACCEGLRCKLWCRKII

SEQ ID NO: 584 - protein, 30 aa, Artificial Sequence; identical to SEQ ID NO: 391
  source: /note="Description of Artificial Sequence: Synthetic polypeptide"
  source: /note="N-term Amino group"
  MOD_RES (1)..(1): CyA
  MOD_RES (2)..(2): Pra
  source: /note="C-term Amide"

SEQ ID NO: 585 - protein, 30 aa, Artificial Sequence; identical to SEQ ID NO: 580
  source: /note="Description of Artificial Sequence: Synthetic polypeptide"
  source: /note="N-term Amino group"
  MOD_RES (1)..(1): Nva
  MOD_RES (2)..(2): Pra
  source: /note="C-term Amide"

SEQ ID NO: 586 - protein, 30 aa, Artificial Sequence; identical to SEQ ID NO: 581
  source: /note="Description of Artificial Sequence: Synthetic polypeptide"
  source: /note="N-term Amino group"
  MOD_RES (2)..(2): Pra
  source: /note="C-term Amide"

SEQ ID NO: 587 - protein, 30 aa, Artificial Sequence; identical to SEQ ID NO: 581
  source: /note="Description of Artificial Sequence: Synthetic polypeptide"
  source: /note="N-term Amino group"
  MOD_RES (1)..(1): D-residue
  MOD_RES (2)..(2): Pra
  source: /note="C-term Amide"

SEQ ID NO: 588 - protein, 31 aa, Artificial Sequence; identical to SEQ ID NO: 583
  source: /note="Description of Artificial Sequence: Synthetic polypeptide"
  source: /note="N-term Amino group"
  MOD_RES (3)..(3): Pra
  source: /note="C-term Amide"

SEQ ID NO: 589 - protein, 65 aa, Odontobuthus doriae
  source: /note="C-term Amide"
GVRDAYIADDKNCVYTCASNGYCNTECTKNGAESGYCQWIGRYGNACWCIKLPDEVPIRIPGKCR

SEQ ID NO: 590 - protein, 34 aa, Artificial Sequence
  Synthetic polypeptide
  MISC_FEATURE (1)..(2): absent or any amino acid residue
  MISC_FEATURE (3)..(3): any amino acid residue
  MISC_FEATURE (4)..(4): Cys if Xaa18 is Cys; or SeCys if Xaa18 is SeCys
  MISC_FEATURE (5)..(5): any neutral hydrophilic or basic amino acid residue
  MISC_FEATURE (6)..(6): Any basic or neutral hydrophilic amino acid residue
  MISC_FEATURE (7)..(7): Trp, 5-bromoTrp, 6-bromoTrp, 5-chloroTrp, 6-chloroTrp, 1-Nal, 2-Nal, thioTrp, BhPhe, 2-BrhF, 2-ClhF, 2-FhF, 2-MehF, 2-MeOhF, 3-BrhF, 3-ClhF, 3-FhF, 3-MehF, 3-MeOhF, 4-BrhF, 4-ClhF, 4-FhF, 4-Me-F, 4-MehF, 4-MeOhF residue
  MISC_FEATURE (8)..(8): Met, Nle, Nva, Leu, Ile, Val, or Phe residue
  MISC_FEATURE (9)..(9): Trp, 5-bromoTrp, 6-bromoTrp, 5-chloroTrp, 6-chloroTrp, 1-Nal, 2-Nal, or thioTrp residue
  MISC_FEATURE (10)..(10): basic or neutral hydrophilic amino acid residue, or an Ala residue
  MISC_FEATURE (11)..(11): Cys if Xaa23 is Cys; or SeCys if Xaa23 is SeCys
  MISC_FEATURE (13)..(13): any amino acid residue
  MISC_FEATURE (14)..(14): basic or acidic residue or an Ala residue
  MISC_FEATURE (15)..(15): Arg or Cit residue
  MISC_FEATURE (16)..(16): any amino acid residue
  MISC_FEATURE (17)..(17): Cys if Xaa27 is Cys; or SeCys if Xaa27 is SeCys
  MISC_FEATURE (18)..(18): Cys or SeCys
  MISC_FEATURE (19)..(19): any amino acid residue
  MISC_FEATURE (20)..(20): Gly, Asp or Ala residue
  MISC_FEATURE (22)..(22): an acidic, basic, or neutral hydrophilic amino acid residue, or Ala or Val residue
  MISC_FEATURE (23)..(23): Cys or SeCys residue
  MISC_FEATURE (24)..(24): basic or neutral hydrophilic amino acid or Ala residue
  MISC_FEATURE (25)..(25): aliphatic hydrophobic residue
  MISC_FEATURE (26)..(26): Trp, 5-bromoTrp, 6-bromoTrp, 5-chloroTrp, 6-chloroTrp, 7-BrW, 1-Nal, 2-Nal, thioTrp, 5-phenylTrp, 5-iPrTrp, 5- ethylTrp, or 5-MeTrp residue
  MISC_FEATURE (27)..(27): Cys or SeCys residue
  MISC_FEATURE (28)..(28): basic or neutral hydrophilic amino acid residue
  MISC_FEATURE (29)..(29): basic amino acid residue, or a Tyr or Leu residue
  MISC_FEATURE (30)..(30): Ile, Trp, Tyr, 5-bromoTrp, 6-bromoTrp, 5-chloroTrp, 6-chloroTrp, thioTrp, 1-Nal, or 2-Nal residue, if Xaa22 is an acidic amino acid residue; or an acidic amino acid residue or a Pro residue, if Xaa22 is a basic or neutral hydrophilic amino acid residue or an Ala or Val residue
  MISC_FEATURE (31)..(31): Ile, Trp, Phe, BhPhe, Cha, Tyr, 5-bromoTrp, 6-bromoTrp, 5-chloroTrp, 6-chloroTrp, 1-Nal, 2-Nal, thioTrp, or 4-tBu-F residue
  MISC_FEATURE (32)..(34): independently absent or is independently a hydrophobic or acidic amino acid residue, or a Ser or Gly residue
XXXXXXXXXXXDXXXXXXXXLXXXXXXXXXXXXX

SEQ ID NO: 591 - protein, 34 aa, Artificial Sequence
  source: /note="Description of Artificial Sequence: Synthetic polypeptide"
  MOD_RES (13)..(13): Atz
  source: /note="C-term Amide"
DCLGFFRKCIPDADKCCRPNLVCSRTHKWCKYVF

SEQ ID NO: 592 - protein, 34 aa, Artificial Sequence
  source: /note="Description of Artificial Sequence: Synthetic polypeptide"
  MOD_RES (13)..(13): Atz
  source: /note="C-term Amide"
DCLGAFRKCIPDADKCCRPNLVCSRLHRWCKYVF

SEQ ID NO: 593 - protein, 35 aa, Thrixopelma pruriens
  source: /note="ProTxI"
ECRYWLGGCSAGQTCCKHLVCSRRHGWCVWDGTFS

SEQ ID NO: 594 - protein, 585 aa, Homo sapiens [sequence omitted]

SEQ ID NO: 595 - protein, 30 aa, Artificial Sequence; identical to SEQ ID NO: 296
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 596 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKAI

SEQ ID NO: 597 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKDI

SEQ ID NO: 598 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKFI

SEQ ID NO: 599 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKGI

SEQ ID NO: 600 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKHI

SEQ ID NO: 601 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKKI

SEQ ID NO: 602 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKLI

SEQ ID NO: 603 - protein, 30 aa, Artificial Sequence; identical to SEQ ID NO: 602
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (29)..(29): Nle
  source: /note="C-term FreeAcid"

SEQ ID NO: 604 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKNI

SEQ ID NO: 605 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKPI

SEQ ID NO: 606 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKQI

SEQ ID NO: 607 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKRI

SEQ ID NO: 608 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKSI

SEQ ID NO: 609 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKTI

SEQ ID NO: 610 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKVI

SEQ ID NO: 611 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKWI

SEQ ID NO: 612 - protein, 30 aa, Artificial Sequence; identical to SEQ ID NO: 596
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (29)..(29): 1-Nal
  source: /note="C-term FreeAcid"

SEQ ID NO: 613 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLACKLWCRKII

SEQ ID NO: 614 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLDCKLWCRKII

SEQ ID NO: 615 - protein, 30 aa, Artificial Sequence; identical to SEQ ID NO: 297
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"

SEQ ID NO: 616 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLFCKLWCRKII

SEQ ID NO: 617 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLGCKLWCRKII

SEQ ID NO: 618 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLHCKLWCRKII

SEQ ID NO: 619 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLICKLWCRKII

SEQ ID NO: 620 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLKCKLWCRKII

SEQ ID NO: 621 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLLCKLWCRKII

SEQ ID NO: 622 - protein, 30 aa, Artificial Sequence; identical to SEQ ID NO: 621
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Nle
  source: /note="C-term FreeAcid"

SEQ ID NO: 623 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLNCKLWCRKII

SEQ ID NO: 624 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLPCKLWCRKII

SEQ ID NO: 625 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLQCKLWCRKII

SEQ ID NO: 626 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLSCKLWCRKII

SEQ ID NO: 627 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLTCKLWCRKII

SEQ ID NO: 628 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLVCKLWCRKII

SEQ ID NO: 629 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLWCKLWCRKII

SEQ ID NO: 630 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLYCKLWCRKII

SEQ ID NO: 631 - protein, 30 aa, Artificial Sequence; identical to SEQ ID NO: 613
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): 1-Nal
  source: /note="C-term FreeAcid"

SEQ ID NO: 632 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLDCKLWCRKEI

SEQ ID NO: 633 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLECKLWCRKEI

SEQ ID NO: 634 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLFCKLWCRKEI

SEQ ID NO: 635 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLGCKLWCRKEI

SEQ ID NO: 636 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLHCKLWCRKEI

SEQ ID NO: 637 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLICKLWCRKEI

SEQ ID NO: 638 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLLCKLWCRKEI

SEQ ID NO: 639 - protein, 30 aa, Artificial Sequence; identical to SEQ ID NO: 638
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Nle
  source: /note="C-term FreeAcid"

SEQ ID NO: 640 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLNCKLWCRKEI

SEQ ID NO: 641 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLPCKLWCRKEI

SEQ ID NO: 642 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLQCKLWCRKEI

SEQ ID NO: 643 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLSCKLWCRKEI

SEQ ID NO: 644 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLTCKLWCRKEI

SEQ ID NO: 645 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLVCKLWCRKEI

SEQ ID NO: 646 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLWCKLWCRKEI

SEQ ID NO: 647 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLYCKLWCRKEI

SEQ ID NO: 648 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): 1-Nal
  source: /note="C-term FreeAcid"
GYCQKWLWTCDSKRACCEGLACKLWCRKEI

SEQ ID NO: 649 - protein, 30 aa, Artificial Sequence; identical to SEQ ID NO: 596
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 650 - protein, 30 aa, Artificial Sequence; identical to SEQ ID NO: 598
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 651 - protein, 30 aa, Artificial Sequence; identical to SEQ ID NO: 599
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 652 - protein, 30 aa, Artificial Sequence; identical to SEQ ID NO: 600
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 653 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKYI

SEQ ID NO: 654 - protein, 30 aa, Artificial Sequence; identical to SEQ ID NO: 601
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 655 - protein, 30 aa, Artificial Sequence; identical to SEQ ID NO: 602
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 656 - protein, 30 aa, Artificial Sequence; identical to SEQ ID NO: 604
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 657 - protein, 30 aa, Artificial Sequence; identical to SEQ ID NO: 605
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 658 - protein, 30 aa, Artificial Sequence; identical to SEQ ID NO: 607
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 659 - protein, 30 aa, Artificial Sequence; identical to SEQ ID NO: 608
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 660 - protein, 30 aa, Artificial Sequence; identical to SEQ ID NO: 609
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 661 - protein, 30 aa, Artificial Sequence; identical to SEQ ID NO: 610
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 662 - protein, 30 aa, Artificial Sequence; identical to SEQ ID NO: 611
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 663 - protein, 30 aa, Artificial Sequence; identical to SEQ ID NO: 596
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (29)..(29): 1-Nal
  source: /note="C-term Amide"

SEQ ID NO: 664 - protein, 30 aa, Artificial Sequence; identical to SEQ ID NO: 602
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (29)..(29): Nle
  source: /note="C-term Amide"

SEQ ID NO: 665 - protein, 30 aa, Artificial Sequence; identical to SEQ ID NO: 606
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 666 - protein, 30 aa, Artificial Sequence; identical to SEQ ID NO: 613
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 667 - protein, 30 aa, Artificial Sequence; identical to SEQ ID NO: 614
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 668 - protein, 30 aa, Artificial Sequence; identical to SEQ ID NO: 616
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 669 - protein, 30 aa, Artificial Sequence; identical to SEQ ID NO: 617
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 670 - protein, 30 aa, Artificial Sequence; identical to SEQ ID NO: 618
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 671 - protein, 30 aa, Artificial Sequence; identical to SEQ ID NO: 619
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 672 - protein, 30 aa, Artificial Sequence; identical to SEQ ID NO: 620
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 673 - protein, 30 aa, Artificial Sequence; identical to SEQ ID NO: 621
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 674 - protein, 30 aa, Artificial Sequence; identical to SEQ ID NO: 621
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Nle
  source: /note="C-term Amide"

SEQ ID NO: 675 - protein, 30 aa, Artificial Sequence; identical to SEQ ID NO: 623
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 676 - protein, 30 aa, Artificial Sequence; identical to SEQ ID NO: 624
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 677 - protein, 30 aa, Artificial Sequence; identical to SEQ ID NO: 625
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 678 - protein, 30 aa, Artificial Sequence; identical to SEQ ID NO: 626
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 679 - protein, 30 aa, Artificial Sequence; identical to SEQ ID NO: 627
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 680 - protein, 30 aa, Artificial Sequence; identical to SEQ ID NO: 628
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 681 - protein, 30 aa, Artificial Sequence; identical to SEQ ID NO: 629
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 682 - protein, 30 aa, Artificial Sequence; identical to SEQ ID NO: 630
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 683 - protein, 30 aa, Artificial Sequence; identical to SEQ ID NO: 613
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): 1-Nal
  source: /note="C-term Amide"

SEQ ID NO: 684 - protein, 30 aa, Artificial Sequence; identical to SEQ ID NO: 632
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 685 - protein, 30 aa, Artificial Sequence; identical to SEQ ID NO: 633
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 686 - protein, 30 aa, Artificial Sequence; identical to SEQ ID NO: 634
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 687 - protein, 30 aa, Artificial Sequence; identical to SEQ ID NO: 635
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 688 - protein, 30 aa, Artificial Sequence; identical to SEQ ID NO: 636
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 689 - protein, 30 aa, Artificial Sequence; identical to SEQ ID NO: 637
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 690 - protein, 30 aa, Artificial Sequence; identical to SEQ ID NO: 638
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 691 - protein, 30 aa, Artificial Sequence; identical to SEQ ID NO: 638
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Nle
  source: /note="C-term Amide"

SEQ ID NO: 692 - protein, 30 aa, Artificial Sequence; identical to SEQ ID NO: 640
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 693 - protein, 30 aa, Artificial Sequence; identical to SEQ ID NO: 641
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 694 - protein, 30 aa, Artificial Sequence; identical to SEQ ID NO: 642
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 695 - protein, 30 aa, Artificial Sequence; identical to SEQ ID NO: 643
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 696 - protein, 30 aa, Artificial Sequence; identical to SEQ ID NO: 644
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 697 - protein, 30 aa, Artificial Sequence; identical to SEQ ID NO: 645
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 698 - protein, 30 aa, Artificial Sequence; identical to SEQ ID NO: 646
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 699 - protein, 30 aa, Artificial Sequence; identical to SEQ ID NO: 647
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 700 - protein, 30 aa, Artificial Sequence; identical to SEQ ID NO: 648
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): 1-Nal
  source: /note="C-term Amide"

SEQ ID NO: 701 - protein, 29 aa, Artificial Sequence
  source: /note="Description of Artificial Sequence: Synthetic peptide"
  source: /note="N-term Amino group"
  MOD_RES (1)..(1): Y3-I
  MOD_RES (6)..(6): Nle
  source: /note="C-term Amide"
ICQKWLWTCDSKRACCEGLRCKLWCRKEI

SEQ ID NO: 702 - protein, 29 aa, Artificial Sequence
  source: /note="Description of Artificial Sequence: Synthetic peptide"
  source: /note="N-term Amino group"
  MOD_RES (1)..(1): Y3-I
  MOD_RES (6)..(6): Nle
  MOD_RES (7)..(7): 1-Nal
  MOD_RES (24)..(24): 1-Nal
  source: /note="C-term Amide"
ICQKWLATCDSKRACCEGLRCKLACRKEI

SEQ ID NO: 703 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGARCKLWCRKEI

SEQ ID NO: 704 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGKRCKLWCRKEI

SEQ ID NO: 705 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGRRCKLWCRKEI

SEQ ID NO: 706 - protein, 30 aa, Artificial Sequence; identical to SEQ ID NO: 703
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (20)..(20): 1-Nal
  source: /note="C-term Amide"

SEQ ID NO: 707 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGYCQKWLWTCDSKRACCEGLRCKLWCRKEI

SEQ ID NO: 708 - protein, 30 aa, Artificial Sequence
  source: /note="Description of Artificial Sequence: Synthetic polypeptide"
  source: /note="N-term Amino group"
  MOD_RES (7)..(7): Nle
  source: /note="C-term Amide"
EYCQKWLWTCDSKRACCEGLRCKLWCRKEI

SEQ ID NO: 709 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCKLWCRKEI

SEQ ID NO: 710 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCEKWLWTCDSKRACCEGLRCKLWCRKEI

SEQ ID NO: 711 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQEWLWTCDSKRACCEGLRCKLWCRKEI

SEQ ID NO: 712 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWECDSKRACCEGLRCKLWCRKEI

SEQ ID NO: 713 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCESKRACCEGLRCKLWCRKEI

SEQ ID NO: 714 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRKEI

SEQ ID NO: 715 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRKEI

SEQ ID NO: 716 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCKLWCRKEI

SEQ ID NO: 717 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRECCEGLRCKLWCRKEI

SEQ ID NO: 718 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCKGLRCKLWCRKEI

SEQ ID NO: 719 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEELRCKLWCRKEI

SEQ ID NO: 720 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGERCKLWCRKEI

SEQ ID NO: 721 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLKCKLWCRKEI

SEQ ID NO: 722 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCELWCRKEI

SEQ ID NO: 723 - protein, 30 aa, Artificial Sequence; identical to SEQ ID NO: 597
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 724 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCEKEI

SEQ ID NO: 725 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCREEI

SEQ ID NO: 726 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKEIE

SEQ ID NO: 727 - protein, 30 aa, Artificial Sequence; identical to SEQ ID NO: 648
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 728 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCKGLRCKLWCRKEI

SEQ ID NO: 729 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCKGLRCKLWCRKII

SEQ ID NO: 730 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRKII

SEQ ID NO: 731 - protein, 28 aa, Artificial Sequence
  source: /note="Description of Artificial Sequence: Synthetic peptide"
  source: /note="N-term Amino group"
  MOD_RES (5)..(5): Nle
  MOD_RES (11)..(11): Lys(ivDde)
  source: /note="C-term Amide"
CQKWLWTCDSKRACCEGLRCKLWCRKEI

SEQ ID NO: 732 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRKEI

SEQ ID NO: 733 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRKEI

SEQ ID NO: 734 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGYCQKWLWTCDEKRACCEGLRCKLWCRKEI

SEQ ID NO: 735 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGYCQKWLWTCDSERACCEGLRCKLWCRKEI

SEQ ID NO: 736 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDEKRACCEGLRCKLWCRKEI

SEQ ID NO: 737 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDSERACCEGLRCKLWCRKEI

SEQ ID NO: 738 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDSKRECCEGLRCKLWCRKEI

SEQ ID NO: 739 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDEKRACCEGLRCKLWCRKEI

SEQ ID NO: 740 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGYCQKWLWTCDSKRECCEGLRCKLWCRKEI

SEQ ID NO: 741 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGECQKWLWTCDEKRACCEGLRCKLWCRKEI

SEQ ID NO: 742 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSERACCEGLRCKLWCRKEI

SEQ ID NO: 743 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRECCEGLRCKLWCRKEI

SEQ ID NO: 744 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRKEI

SEQ ID NO: 745 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRECCEGLRCKLWCRKEI

SEQ ID NO: 746 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGECQKWLWTCDSERACCEGLRCKLWCRKEI

SEQ ID NO: 747 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERECCEGLRCKLWCRKEI

SEQ ID NO: 748 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDEERACCEGLRCKLWCRKEI

SEQ ID NO: 749 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDSERECCEGLRCKLWCRKEI

SEQ ID NO: 750 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (7)..(7): Nle
  source: /note="C-term Amide"
EGCQKWLWTCDEKRECCEGLRCKLWCRKEI

SEQ ID NO: 751 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDEKRECCEGLRCKLWCRKEI

SEQ ID NO: 752 - protein, 31 aa, Artificial Sequence
  source: /note="Description of Artificial Sequence: Synthetic polypeptide"
  source: /note="N-term Amino group"
  MOD_RES (2)..(2): Pra
  MOD_RES (8)..(8): Nle
  source: /note="C-term Amide"
EGECQKWLWTCDSKRECCEGLRCKLWCRKEI

SEQ ID NO: 753 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSERECCEGLRCKLWCRKEI

SEQ ID NO: 754 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDEERACCEGLRCKLWCRKEI

SEQ ID NO: 755 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERECCEGLRCKLWCRKEI

SEQ ID NO: 756 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSERECCGGLRCKLWCRKEI

SEQ ID NO: 757 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDEERECCGGLRCKLWCRKEI

SEQ ID NO: 758 - protein, 30 aa, Artificial Sequence; identical to SEQ ID NO: 388
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"

SEQ ID NO: 759 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRKII

SEQ ID NO: 760 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRKII

SEQ ID NO: 761 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCREII

SEQ ID NO: 762 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (18)..(18): Pra
  source: /note="C-term Amide"
VYCQKWLWTCDSERECCGGLRCKLWCRKII

SEQ ID NO: 763 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCREII

SEQ ID NO: 764 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCREEI

SEQ ID NO: 765 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRKEI

SEQ ID NO: 766 - protein, 30 aa, Artificial Sequence
  source: /note="Description of Artificial Sequence: Synthetic polypeptide"
  source: /note="N-term Amino group"
  MOD_RES (2)..(2): CyA
  MOD_RES (7)..(7): Nle
  MOD_RES (18)..(18): Pra
  source: /note="C-term Amide"
EACQKWLWTCDEKRACCGGLRCKLWCRKEI

SEQ ID NO: 767 - protein, 30 aa, Artificial Sequence
  source: /note="Description of Artificial Sequence: Synthetic polypeptide"
  source: /note="N-term Amino group"
  MOD_RES (7)..(7): Nle
  MOD_RES (18)..(18): Pra
  source: /note="C-term Amide"
EYCQKWLWTCDEKRACCGGLRCKLWCRKEI

SEQ ID NO: 768 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDEKRACCGGLRCKLWCRKEI

SEQ ID NO: 769 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Pra
  source: /note="C-term Amide"
EVYCQKWLWTCDEKRACCGGLRCKLWCRKEI

SEQ ID NO: 770 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (18)..(18): Pra
  source: /note="C-term Amide"
VECQKWLWTCDSKRECCGGLRCKLWCRKEI

SEQ ID NO: 771 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRECCGGLRCKLWCRKEI

SEQ ID NO: 772 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Pra
  source: /note="C-term Amide"
EVECQKWLWTCDEKRACCGGLRCKLWCRKEI

SEQ ID NO: 773 - protein, 30 aa, Artificial Sequence
  source: /note="Description of Artificial Sequence: Synthetic polypeptide"
  source: /note="N-term Amino group"
  MOD_RES (2)..(2): Nva
  MOD_RES (7)..(7): Nle
  MOD_RES (18)..(18): Pra
  source: /note="C-term Amide"
EVCQKWLWTCDSKRECCGGLRCKLWCRKEI

SEQ ID NO: 774 - protein, 30 aa, Artificial Sequence
  source: /note="Description of Artificial Sequence: Synthetic polypeptide"
  source: /note="N-term Amino group"
  MOD_RES (2)..(2): Nva
  MOD_RES (7)..(7): Nle
  MOD_RES (18)..(18): Pra
  source: /note="C-term Amide"
EVCQKWLWTCDEKRACCGGLRCKLWCRKEI

SEQ ID NO: 775 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  source: /note="C-term Amide"
GYCQKWLWTCDSKXACCEGLRCKLWCRKEI

SEQ ID NO: 776 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (5)..(5): BhGln
  MOD_RES (7)..(7): Nle
  source: /note="C-term Amide"
GYCQQWLWTCDSKRACCEGLRCKLWCRKEI

SEQ ID NO: 777 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (13)..(13): BhGln
  source: /note="C-term Amide"
GYCQKWLWTCDSQRACCEGLRCKLWCRKEI

SEQ ID NO: 778 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): BhGln
  source: /note="C-term Amide"
GYCQKWLWTCDSKQACCEGLRCKLWCRKEI

SEQ ID NO: 779 - protein, 30 aa, Artificial Sequence; identical to SEQ ID NO: 642
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): BhGln
  source: /note="C-term Amide"

SEQ ID NO: 780 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (23)..(23): BhGln
  source: /note="C-term Amide"
GYCQKWLWTCDSKRACCEGLRCQLWCRKEI

SEQ ID NO: 781 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): BhGln
  source: /note="C-term Amide"
GYCQKWLWTCDSKRACCEGLRCKLWCQKEI

SEQ ID NO: 782 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (28)..(28): BhGln
  source: /note="C-term Amide"
GYCQKWLWTCDSKRACCEGLRCKLWCRQEI

SEQ ID NO: 783 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (5)..(5): BhGln
  MOD_RES (7)..(7): Nle
  MOD_RES (14)..(14): Cit
  source: /note="C-term Amide"
GYCQQWLWTCDSKXACCEGLRCKLWCRKEI

SEQ ID NO: 784 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (5)..(5): BhGln
  MOD_RES (7)..(7): Nle
  MOD_RES (21)..(21): Cit
  source: /note="C-term Amide"
GYCQQWLWTCDSKRACCEGLXCKLWCRKEI

SEQ ID NO: 785 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (5)..(5): BhGln
  MOD_RES (7)..(7): Nle
  MOD_RES (27)..(27): Cit
  source: /note="C-term Amide"
GYCQQWLWTCDSKRACCEGLRCKLWCXKEI

SEQ ID NO: 786 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (13)..(13): BhGln
  MOD_RES (14)..(14): Cit
  source: /note="C-term Amide"
GYCQKWLWTCDSQXACCEGLRCKLWCRKEI

SEQ ID NO: 787 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (13)..(13): BhGln
  MOD_RES (21)..(21): Cit
  source: /note="C-term Amide"
GYCQKWLWTCDSQRACCEGLXCKLWCRKEI

SEQ ID NO: 788 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (13)..(13): BhGln
  MOD_RES (27)..(27): Cit
  source: /note="C-term Amide"
GYCQKWLWTCDSQRACCEGLRCKLWCXKEI

SEQ ID NO: 789 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  MOD_RES (23)..(23): BhGln
  source: /note="C-term Amide"
GYCQKWLWTCDSKXACCEGLRCQLWCRKEI

SEQ ID NO: 790 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  MOD_RES (23)..(23): BhGln
  source: /note="C-term Amide"
GYCQKWLWTCDSKRACCEGLXCQLWCRKEI

SEQ ID NO: 791 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (23)..(23): BhGln
  MOD_RES (27)..(27): Cit
  source: /note="C-term Amide"
GYCQKWLWTCDSKRACCEGLRCQLWCXKEI

SEQ ID NO: 792 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  MOD_RES (28)..(28): BhGln
  source: /note="C-term Amide"
GYCQKWLWTCDSKXACCEGLRCKLWCRQEI

SEQ ID NO: 793 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  MOD_RES (28)..(28): BhGln
  source: /note="C-term Amide"
GYCQKWLWTCDSKRACCEGLXCKLWCRQEI

SEQ ID NO: 794 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  MOD_RES (28)..(28): BhGln
  source: /note="C-term Amide"
GYCQKWLWTCDSKRACCEGLRCKLWCXQEI

SEQ ID NO: 795 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  source: /note="C-term Amide"
GYCQKWLWTCDSKRACCEGLXCKLWCRKEI

SEQ ID NO: 796 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  source: /note="C-term Amide"
GYCQKWLWTCDSKRACCEGLRCKLWCXKEI

SEQ ID NO: 797 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  MOD_RES (21)..(21): Cit
  source: /note="C-term Amide"
GYCQKWLWTCDSKXACCEGLXCKLWCRKEI

SEQ ID NO: 798 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  MOD_RES (27)..(27): Cit
  source: /note="C-term Amide"
GYCQKWLWTCDSKXACCEGLRCKLWCXKEI

SEQ ID NO: 799 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  MOD_RES (27)..(27): Cit
  source: /note="C-term Amide"
GYCQKWLWTCDSKRACCEGLXCKLWCXKEI

SEQ ID NO: 800 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  MOD_RES (21)..(21): Cit
  MOD_RES (27)..(27): Cit
  source: /note="C-term Amide"
GYCQKWLWTCDSKXACCEGLXCKLWCXKEI

SEQ ID NO: 801 - protein, 30 aa, Artificial Sequence; identical to SEQ ID NO: 776
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 802 - protein, 30 aa, Artificial Sequence; identical to SEQ ID NO: 777
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 803 - protein, 30 aa, Artificial Sequence; identical to SEQ ID NO: 778
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 804 - protein, 30 aa, Artificial Sequence; identical to SEQ ID NO: 780
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 805 - protein, 30 aa, Artificial Sequence; identical to SEQ ID NO: 781
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 806 - protein, 30 aa, Artificial Sequence; identical to SEQ ID NO: 782
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"

SEQ ID NO: 807 - protein, 30 aa, Artificial Sequence; identical to SEQ ID NO: 783
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  source: /note="C-term Amide"

SEQ ID NO: 808 - protein, 30 aa, Artificial Sequence; identical to SEQ ID NO: 784
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  source: /note="C-term Amide"

SEQ ID NO: 809 - protein, 30 aa, Artificial Sequence; identical to SEQ ID NO: 785
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  source: /note="C-term Amide"

SEQ ID NO: 810 - protein, 30 aa, Artificial Sequence; identical to SEQ ID NO: 786
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  source: /note="C-term Amide"

SEQ ID NO: 811 - protein, 30 aa, Artificial Sequence; identical to SEQ ID NO: 787
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  source: /note="C-term Amide"

SEQ ID NO: 812 - protein, 30 aa, Artificial Sequence; identical to SEQ ID NO: 793
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  source: /note="C-term Amide"

SEQ ID NO: 813 - protein, 30 aa, Artificial Sequence; identical to SEQ ID NO: 794
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  source: /note="C-term Amide"

SEQ ID NO: 814 - protein, 30 aa, Artificial Sequence; identical to SEQ ID NO: 788
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  source: /note="C-term Amide"

SEQ ID NO: 815 - protein, 30 aa, Artificial Sequence; identical to SEQ ID NO: 792
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  source: /note="C-term Amide"

SEQ ID NO: 816 - protein, 30 aa, Artificial Sequence; identical to SEQ ID NO: 789
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (14)..(14): Cit
  source: /note="C-term Amide"

SEQ ID NO: 817 - protein, 30 aa, Artificial Sequence; identical to SEQ ID NO: 790
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  source: /note="C-term Amide"

SEQ ID NO: 818 - protein, 30 aa, Artificial Sequence; identical to SEQ ID NO: 791
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (27)..(27): Cit
  source: /note="C-term Amide"

SEQ ID NO: 819 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARACCGGLRCKLWCRKEI

SEQ ID NO: 820 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGDLRCKLWCRKEI

SEQ ID NO: 821 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRKEI

SEQ ID NO: 822 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCQLWCRKEI

SEQ ID NO: 823 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRYEI

SEQ ID NO: 824 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRLEI

SEQ ID NO: 825 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERKCCEGYVCELWCKYNL

SEQ ID NO: 826 - protein, 29 aa, Artificial Sequence
  source: /note="Description of Artificial Sequence: Synthetic peptide"
  source: /note="N-term Amino group"
  MOD_RES (6)..(6): Nle
  MOD_RES (17)..(17): Pra
  source: /note="C-term Amide"
YCQKWLWTCDSERKCCGGYVCELWCKYNL

SEQ ID NO: 827 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"

SEQ ID NO: 828 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKEIG

SEQ ID NO: 829 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"

SEQ ID NO: 830 - protein, 31 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCKKKLW

SEQ ID NO: 831 - protein, 33 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKEIEEG

SEQ ID NO: 832 - protein, 33 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKKIEEG

SEQ ID NO: 833 - protein, 32 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKEIEW

SEQ ID NO: 834 - protein, 32 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKKIEW

SEQ ID NO: 835 - protein, 30 aa, Artificial Sequence; identical to SEQ ID NO: 715
  source: /note="Description of Artificial Sequence: Synthetic polypeptide"
  source: /note="N-term Amino group"
  MOD_RES (1)..(1): Pra
  MOD_RES (3)..(3): SeCys
  MOD_RES (7)..(7): Nle
  MOD_RES (17)..(17): SeCys
  source: /note="C-term Amide"

SEQ ID NO: 836 - protein, 30 aa, Artificial Sequence; identical to SEQ ID NO: 715
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (10)..(10): SeCys
  MOD_RES (22)..(22): SeCys
  source: /note="C-term Amide"

SEQ ID NO: 837 - protein, 30 aa, Artificial Sequence; identical to SEQ ID NO: 715
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (16)..(16): SeCys
  MOD_RES (26)..(26): SeCys
  source: /note="C-term Amide"

SEQ ID NO: 838 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (3)..(3): SeCys
  MOD_RES (7)..(7): Nle
  MOD_RES (17)..(17): SeCys
  source: /note="C-term Amide"

SEQ ID NO: 839 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (10)..(10): SeCys
  MOD_RES (22)..(22): SeCys
  source: /note="C-term Amide"

SEQ ID NO: 840 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (16)..(16): SeCys
  MOD_RES (26)..(26): SeCys
  source: /note="C-term Amide"

SEQ ID NO: 841 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): 1-Nal
  MOD_RES (7)..(7): Nle
  source: /note="C-term Amide"
GYCQKALWTCDSKRACCEGLRCKLWCRKEI

SEQ ID NO: 842 - protein, 30 aa, Artificial Sequence; identical to SEQ ID NO: 841
  source: /note="Description of Artificial Sequence: Synthetic polypeptide"
  source: /note="N-term Amino group"
  MOD_RES (1)..(1): Pra
  MOD_RES (6)..(6): 2-Nal
  MOD_RES (7)..(7): Nle
  source: /note="C-term Amide"

SEQ ID NO: 843 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKFLWTCDSKRACCEGLRCKLWCRKEI

SEQ ID NO: 844 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  source: /note="C-term Amide"

SEQ ID NO: 845 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (6)..(6): 5-Br-Trp
  MOD_RES (7)..(7): Nle
  source: /note="C-term Amide"

SEQ ID NO: 846 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (8)..(8): 1-Nal
  source: /note="C-term Amide"
GYCQKWLATCDSKRACCEGLRCKLWCRKEI

SEQ ID NO: 847 - protein, 30 aa, Artificial Sequence; identical to SEQ ID NO: 846
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (8)..(8): 2-Nal
  source: /note="C-term Amide"

SEQ ID NO: 848 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLFTCDSKRACCEGLRCKLWCRKEI

SEQ ID NO: 849 - protein, 30 aa, Artificial Sequence; identical to SEQ ID NO: 848
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (8)..(8): hPhe
  source: /note="C-term Amide"

SEQ ID NO: 850 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (8)..(8): 5-Br-Trp
  source: /note="C-term Amide"

SEQ ID NO: 851 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 1-Nal
  source: /note="C-term Amide"
GYCQKWLWTCDSKRACCEGLRCKLACRKEI

SEQ ID NO: 852 - protein, 30 aa, Artificial Sequence; identical to SEQ ID NO: 851
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 2-Nal
  source: /note="C-term Amide"

SEQ ID NO: 853 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLFCRKEI

SEQ ID NO: 854 - protein, 30 aa, Artificial Sequence; identical to SEQ ID NO: 853
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): hPhe
  source: /note="C-term Amide"

SEQ ID NO: 855 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKIWCRKEI

SEQ ID NO: 856 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Nle
  source: /note="C-term Amide"

SEQ ID NO: 857 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Nva
  source: /note="C-term Amide"
GYCQKWLWTCDSKRACCEGLRCKVWCRKEI

SEQ ID NO: 858 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 859 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  source: /note="C-term Amide"
GYCQKWLWTCDSKRACCEGLRCKGWCRKEI

SEQ ID NO: 860 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Cha
  source: /note="C-term Amide"
GYCQKWLWTCDSKRACCEGLRCKAWCRKEI

SEQ ID NO: 861 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKEF

SEQ ID NO: 862 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (30)..(30): Cha
  source: /note="C-term Amide"
GYCQKWLWTCDSKRACCEGLRCKLWCRKEA

SEQ ID NO: 863 - protein, 30 aa, Artificial Sequence
  source: /note="Description of Artificial Sequence: Synthetic polypeptide"
  source: /note="N-term Amino group"
  MOD_RES (1)..(1): Pra
  source: /note="C-term Amide"
GYCQKWFWTCDSKRACCEGLRCKLWCRKEI

SEQ ID NO: 864 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  source: /note="C-term Amide"
AYCQKFLWTCDSKRACCGGLRCKLWCRKEI

SEQ ID NO: 865 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (30)..(30): Cha
  source: /note="C-term Amide"
AYCQKWLWTCDSKRACCGGLRCKLWCRKEA

SEQ ID NO: 866 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (30)..(30): Cha
  source: /note="C-term Amide"
AECQKWLWTCDSKRACCGGLRCKLWCRKEA

SEQ ID NO: 867 - protein, 30 aa, Artificial Sequence
  source: /note="Description of Artificial Sequence: Synthetic polypeptide"
  source: /note="N-term Amino group"
  MOD_RES (6)..(6): hPhe
  MOD_RES (7)..(7): Nle
  MOD_RES (18)..(18): Pra
  MOD_RES (30)..(30): Cha
  source: /note="C-term Amide"
EYCQKFLWTCDSKRACCGGLRCKLWCRKEA

SEQ ID NO: 868 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Pra
  MOD_RES (31)..(31): Cha
  source: /note="C-term Amide"
EVYCQKWLWTCDSKRACCGGLRCKLWCRKEA

SEQ ID NO: 869 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (30)..(30): Cha
  source: /note="C-term Amide"
AECQKWLWTCDEKRACCGGLRCKLWCRKEA

SEQ ID NO: 870 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 871 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 872 - protein, 30 aa, Artificial Sequence; identical to SEQ ID NO: 388
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 873 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 6-Br-Trp
  source: /note="C-term Amide"

SEQ ID NO: 874 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 6-Me-Trp
  source: /note="C-term Amide"

SEQ ID NO: 875 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 7-Br-Trp
  source: /note="C-term Amide"

SEQ ID NO: 876 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRKEF

SEQ ID NO: 877 - protein, 30 aa, Artificial Sequence; identical to SEQ ID NO: 876
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (30)..(30): hPhe
  source: /note="C-term Amide"

SEQ ID NO: 878 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (30)..(30): Cha
  source: /note="C-term Amide"
GYCQKFLWTCDSKRACCEGLRCKLWCRKEA

SEQ ID NO: 879 - protein, 29 aa, Artificial Sequence
  source: /note="Description of Artificial Sequence: Synthetic peptide"
  source: /note="N-term Amino group"
  MOD_RES (6)..(6): Nle
  MOD_RES (12)..(12): Pra
  source: /note="C-term Amide"
YCQKWLWTCDSGRACCEGLRCKLWCRKEI

SEQ ID NO: 880 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): KPPG3
  source: /note="C-term Amide"

SEQ ID NO: 881 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (15)..(15): KPPG3
  source: /note="C-term Amide"

SEQ ID NO: 882 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (13)..(13): Lys(AOA)
  source: /note="C-term Amide"

SEQ ID NO: 883 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz(NPeg9)
  MOD_RES (7)..(7): Nle
  source: /note="C-term Amide"

SEQ ID NO: 884 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz(PEG11-bromoacetamide)
  MOD_RES (7)..(7): Nle
  source: /note="C-term Amide"

SEQ ID NO: 885 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz
  MOD_RES (7)..(7): Nle
  source: /note="C-term Amide"

SEQ ID NO: 886 - protein, 30 aa, Artificial Sequence; identical to SEQ ID NO: 368
  source: /note="Description of Artificial Sequence: Synthetic polypeptide"
  source: /note="N-term Amino group"
  MOD_RES (1)..(1): N3PGAzNH
  MOD_RES (7)..(7): Nle
  source: /note="C-term Amide"

SEQ ID NO: 887 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): Atz(PEG11-bromoacetamide)
  MOD_RES (7)..(7): Nle
  source: /note="C-term Amide"

SEQ ID NO: 888 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz(PEG11-bromoacetamide)
  source: /note="C-term Amide"

SEQ ID NO: 889 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz
  source: /note="C-term Amide")

SEQ ID NO: 890 - protein, 31 aa, Artificial Sequence
  source: /note="Description of Artificial Sequence: Synthetic polypeptide"
  source: /note="N-term Amino group"
  MOD_RES (2)..(2): CyA
  MOD_RES (8)..(8): Nle
  MOD_RES (16)..(16): Lys(Atz(PEG11-bromoacetamide))
  source: /note="C-term Amide"
KAYCQKWLWTCDSKRKCCEGLRCKLWCRKEI

SEQ ID NO: 891 - protein, 31 aa, Artificial Sequence; identical to SEQ ID NO: 890
  source: /note="Description of Artificial Sequence: Synthetic polypeptide"
  source: /note="N-term Amino group"
  MOD_RES (2)..(2): CyA
  MOD_RES (8)..(8): Nle
  MOD_RES (16)..(16): Lys(Atz(NPeg9))
  source: /note="C-term Amide"

SEQ ID NO: 892 - protein, 31 aa, Artificial Sequence; identical to SEQ ID NO: 890
  source: /note="Description of Artificial Sequence: Synthetic polypeptide"
  source: /note="N-term Amino group"
  MOD_RES (2)..(2): CyA
  MOD_RES (8)..(8): Nle
  MOD_RES (16)..(16): Lys(Atz)
  source: /note="C-term Amide"

SEQ ID NO: 893 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz
  MOD_RES (7)..(7): Nle
  MOD_RES (25)..(25): 5-Br-Trp
  source: /note="C-term Amide"

SEQ ID NO: 894 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz
  MOD_RES (25)..(25): 5-Br-Trp
  source: /note="C-term Amide"

SEQ ID NO: 895 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz(palmitate)
  source: /note="C-term Amide"

SEQ ID NO: 896 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz modified with a unique side chain
  source: /note="C-term Amide"
  source: /note="see specification as filed for detailed description of substitutions and preferred embodiments"

SEQ ID NO: 897 - protein, 30 aa, Artificial Sequence; identical to SEQ ID NO: 443
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Atz modified with a unique side chain
  source: /note="C-term Amide"
  source: /note="see specification as filed for detailed description of substitutions and preferred embodiments"

SEQ ID NO: 898 - protein, 30 aa, Artificial Sequence; identical to SEQ ID NO: 247
  source: /note="Description of Artificial Sequence: Synthetic polypeptide"
  source: /note="N-term Amino group"
  MOD_RES (1)..(1): Atz(ClickBiotin)
  MOD_RES (7)..(7): Nle
  source: /note="C-term Amide"

SEQ ID NO: 899 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz(palmitate)
  MOD_RES (7)..(7): Nle
  source: /note="C-term Amide"

SEQ ID NO: 900 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): Atz(palmitate)
  MOD_RES (7)..(7): Nle
  source: /note="C-term Amide"
AACQKWLWTCDSKRACCEGLRCKLWCRKEI

SEQ ID NO: 901 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Atz(palmitate)
  source: /note="C-term Amide"
AYCQKWLWTCDAKRACCEGLRCKLWCRKEI

SEQ ID NO: 902 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Atz(palmitate)
  source: /note="C-term Amide"
AYCQKWLWTCDSARACCEGLRCKLWCRKEI

SEQ ID NO: 903 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys(Atz(palmitate))
  source: /note="C-term Amide"

SEQ ID NO: 904 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz modified with a unique sidechain
  MOD_RES (7)..(7): Nle
  source: /note="C-term Amide"
  source: /note="see specification as filed for detailed description of substitutions and preferred embodiments"

SEQ ID NO: 905 - protein, 30 aa, Artificial Sequence; identical to SEQ ID NO: 900
  source: /note="Description of Artificial Sequence: Synthetic polypeptide"
  source: /note="N-term Amino group"
  MOD_RES (1)..(1): CyA
  MOD_RES (2)..(2): Atz modified with a unique side chain
  MOD_RES (7)..(7): Nle
  source: /note="C-term Amide"
  source: /note="see specification as filed for detailed description of substitutions and preferred embodiments"

SEQ ID NO: 906 - protein, 30 aa, Artificial Sequence; identical to SEQ ID NO: 901
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Atz modified with a unique side chain
  source: /note="C-term Amide"
  source: /note="see specification as filed for detailed description of substitutions and preferred embodiments"

SEQ ID NO: 907 - protein, 30 aa, Artificial Sequence; identical to SEQ ID NO: 902
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): Atz modified with a unique side chain
  source: /note="C-term Amide"

SEQ ID NO: 908 - protein, 30 aa, Artificial Sequence; identical to SEQ ID NO: 392
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): Lys modified with a unique side chain
  source: /note="C-term Amide"
  source: /note="see specification as filed for detailed description of substitutions and preferred embodiments"

SEQ ID NO: 909 - protein, 31 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKEIW

SEQ ID NO: 910 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRLNL

SEQ ID NO: 911 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKEIW

SEQ ID NO: 912 - protein, 32 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKEIEW

SEQ ID NO: 913 - protein, 33 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKEIEEG

SEQ ID NO: 914 - protein, 32 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKKIEW

SEQ ID NO: 915 - protein, 33 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKKIEEG

SEQ ID NO: 916 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRLNL

SEQ ID NO: 917 - protein, 31 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKIIW

SEQ ID NO: 918 - protein, 32 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKIIEW

SEQ ID NO: 919 - protein, 33 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term FreeAcid"
AYCQKWLWTCDSKRACCGGLRCKLWCRKIIEEG

SEQ ID NO: 920 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKIIW

SEQ ID NO: 921 - protein, 32 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKIIEW

SEQ ID NO: 922 - protein, 33 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKIIEEG

SEQ ID NO: 923 - protein, 31 aa, Artificial Sequence; identical to SEQ ID NO: 909
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 924 - protein, 32 aa, Artificial Sequence; identical to SEQ ID NO: 833
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 925 - protein, 33 aa, Artificial Sequence; identical to SEQ ID NO: 831
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 926 - protein, 32 aa, Artificial Sequence; identical to SEQ ID NO: 834
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 927 - protein, 33 aa, Artificial Sequence; identical to SEQ ID NO: 832
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 928 - protein, 30 aa, Artificial Sequence; identical to SEQ ID NO: 910
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 929 - protein, 31 aa, Artificial Sequence; identical to SEQ ID NO: 911
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 930 - protein, 32 aa, Artificial Sequence; identical to SEQ ID NO: 912
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 931 - protein, 33 aa, Artificial Sequence; identical to SEQ ID NO: 913
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 932 - protein, 32 aa, Artificial Sequence; identical to SEQ ID NO: 914
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 933 - protein, 33 aa, Artificial Sequence; identical to SEQ ID NO: 915
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 934 - protein, 30 aa, Artificial Sequence; identical to SEQ ID NO: 916
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 935 - protein, 31 aa, Artificial Sequence; identical to SEQ ID NO: 917
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 936 - protein, 32 aa, Artificial Sequence; identical to SEQ ID NO: 918
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 937 - protein, 33 aa, Artificial Sequence; identical to SEQ ID NO: 919
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"

SEQ ID NO: 938 - protein, 31 aa, Artificial Sequence; identical to SEQ ID NO: 920
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 939 - protein, 32 aa, Artificial Sequence; identical to SEQ ID NO: 921
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 940 - protein, 33 aa, Artificial Sequence; identical to SEQ ID NO: 922
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"

SEQ ID NO: 941 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSARACCGGLRCKLWCRKEI

SEQ ID NO: 942 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGDLRCKLWCRKEI

SEQ ID NO: 943 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLVCKLWCRKEI

SEQ ID NO: 944 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCQLWCRKEI

SEQ ID NO: 945 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCKLWCRYEI

SEQ ID NO: 946 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCKLWCRLEI

SEQ ID NO: 947 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEARACCGGLRCKLWCRKEI

SEQ ID NO: 948 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGDLRCKLWCRKEI

SEQ ID NO: 949 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLVCKLWCRKEI

SEQ ID NO: 950 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCQLWCRKEI

SEQ ID NO: 951 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRYEI

SEQ ID NO: 952 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRLEI

SEQ ID NO: 953 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGDLRCKLWCRKEI

SEQ ID NO: 954 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLVCKLWCRKEI

SEQ ID NO: 955 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCQLWCRKEI

SEQ ID NO: 956 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRYEI

SEQ ID NO: 957 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRLEI

SEQ ID NO: 958 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARECCGGLRCKLWCRKEI

SEQ ID NO: 959 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGDLRCKLWCRKEI

SEQ ID NO: 960 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLVCKLWCRKEI

SEQ ID NO: 961 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCQLWCRKEI

SEQ ID NO: 962 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRYEI

SEQ ID NO: 963 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRLEI

SEQ ID NO: 964 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARACCGGLVCKLWCRKEI

SEQ ID NO: 965 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGDLVCKLWCRKEI

SEQ ID NO: 966 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCQLWCRKEI

SEQ ID NO: 967 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRYEI

SEQ ID NO: 968 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRLEI

SEQ ID NO: 969 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRKEI

SEQ ID NO: 970 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGDLRCKLWCRKEI

SEQ ID NO: 971 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRKEI

SEQ ID NO: 972 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCQLWCRKEI

SEQ ID NO: 973 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRYEI

SEQ ID NO: 974 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRLEI

SEQ ID NO: 975 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCQLWCRKEI

SEQ ID NO: 976 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRYEI

SEQ ID NO: 977 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRLEI

SEQ ID NO: 978 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRKEI

SEQ ID NO: 979 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCQLWCRKEI

SEQ ID NO: 980 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCKLWCRYEI

SEQ ID NO: 981 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCKLWCRLEI

SEQ ID NO: 982 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCQLWCRKEI

SEQ ID NO: 983 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRYEI

SEQ ID NO: 984 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRLEI

SEQ ID NO: 985 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRYNL

SEQ ID NO: 986 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSARACCEGLRCKLWCRKEI

SEQ ID NO: 987 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEDLRCKLWCRKEI

SEQ ID NO: 988 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRYEI

SEQ ID NO: 989 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRLEI

SEQ ID NO: 990 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSARACCEGLRCKLWCRKEI

SEQ ID NO: 991 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEDLRCKLWCRKEI

SEQ ID NO: 992 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLVCKLWCRKEI

SEQ ID NO: 993 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCQLWCRKEI

SEQ ID NO: 994 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCKLWCRYEI

SEQ ID NO: 995 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCKLWCRLEI

SEQ ID NO: 996 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEARACCEGLRCKLWCRKEI

SEQ ID NO: 997 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEDLRCKLWCRKEI

SEQ ID NO: 998 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLVCKLWCRKEI

SEQ ID NO: 999 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCQLWCRKEI

SEQ ID NO: 1000 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRYEI

SEQ ID NO: 1001 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRLEI

SEQ ID NO: 1002 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEDLRCKLWCRKEI

SEQ ID NO: 1003 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLVCKLWCRKEI

SEQ ID NO: 1004 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCQLWCRKEI

SEQ ID NO: 1005 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRYEI

SEQ ID NO: 1006 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRLEI

SEQ ID NO: 1007 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSAEACCEGLRCKLWCRKEI

SEQ ID NO: 1008 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEDLRCKLWCRKEI

SEQ ID NO: 1009 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLVCKLWCRKEI

SEQ ID NO: 1010 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCQLWCRKEI

SEQ ID NO: 1011 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCKLWCRYEI

SEQ ID NO: 1012 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCKLWCRLEI

SEQ ID NO: 1013 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSARACCEGLVCKLWCRKEI

SEQ ID NO: 1014 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEDLVCKLWCRKEI

SEQ ID NO: 1015 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCQLWCRKEI

SEQ ID NO: 1016 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCKLWCRYEI

SEQ ID NO: 1017 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCKLWCRLEI

SEQ ID NO: 1018 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEDLRCKLWCRKEI

SEQ ID NO: 1019 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRKEI

SEQ ID NO: 1020 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCQLWCRKEI

SEQ ID NO: 1021 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRYEI

SEQ ID NO: 1022 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRLEI

SEQ ID NO: 1023 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCQLWCRKEI

SEQ ID NO: 1024 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRYEI

SEQ ID NO: 1025 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRLEI

SEQ ID NO: 1026 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRKEI

SEQ ID NO: 1027 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCQLWCRKEI

SEQ ID NO: 1028 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCKLWCRYEI

SEQ ID NO: 1029 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCKLWCRLEI

SEQ ID NO: 1030 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCQLWCRKEI

SEQ ID NO: 1031 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRYEI

SEQ ID NO: 1032 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRLEI

SEQ ID NO: 1033 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRYNL

SEQ ID NO: 1034 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRKII

SEQ ID NO: 1035 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARACCGGLRCKLWCRKII

SEQ ID NO: 1036 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGDLRCKLWCRKII

SEQ ID NO: 1037 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRKII

SEQ ID NO: 1038 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCQLWCRKII

SEQ ID NO: 1039 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRYII

SEQ ID NO: 1040 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLRCKLWCRLII

SEQ ID NO: 1041 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSARACCGGLRCKLWCRKII

SEQ ID NO: 1042 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGDLRCKLWCRKII

SEQ ID NO: 1043 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLVCKLWCRKII

SEQ ID NO: 1044 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCQLWCRKII

SEQ ID NO: 1045 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCKLWCRYII

SEQ ID NO: 1046 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AECQKWLWTCDSKRACCGGLRCKLWCRLII

SEQ ID NO: 1047 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEARACCGGLRCKLWCRKII

SEQ ID NO: 1048 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGDLRCKLWCRKII

SEQ ID NO: 1049 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLVCKLWCRKII

SEQ ID NO: 1050 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCQLWCRKII

SEQ ID NO: 1051 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRYII

SEQ ID NO: 1052 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEKRACCGGLRCKLWCRLII

SEQ ID NO: 1053 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGDLRCKLWCRKII

SEQ ID NO: 1054 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLVCKLWCRKII

SEQ ID NO: 1055 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCQLWCRKII

SEQ ID NO: 1056 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRYII

SEQ ID NO: 1057 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRLII

SEQ ID NO: 1058 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARECCGGLRCKLWCRKII

SEQ ID NO: 1059 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGDLRCKLWCRKII

SEQ ID NO: 1060 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLVCKLWCRKII

SEQ ID NO: 1061 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCQLWCRKII

SEQ ID NO: 1062 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRYII

SEQ ID NO: 1063 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRECCGGLRCKLWCRLII

SEQ ID NO: 1064 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSARACCGGLVCKLWCRKII

SEQ ID NO: 1065 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGDLVCKLWCRKII

SEQ ID NO: 1066 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCQLWCRKII

SEQ ID NO: 1067 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRYII

SEQ ID NO: 1068 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSKRACCGGLVCKLWCRLII

SEQ ID NO: 1069 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRKII

SEQ ID NO: 1070 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGDLRCKLWCRKII

SEQ ID NO: 1071 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRKII

SEQ ID NO: 1072 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCQLWCRKII

SEQ ID NO: 1073 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRYII

SEQ ID NO: 1074 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLRCKLWCRLII

SEQ ID NO: 1075 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCQLWCRKII

SEQ ID NO: 1076 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRYII

SEQ ID NO: 1077 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDEERACCGGLVCKLWCRLII

SEQ ID NO: 1078 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRKII

SEQ ID NO: 1079 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCQLWCRKII

SEQ ID NO: 1080 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCKLWCRYII

SEQ ID NO: 1081 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELRCKLWCRLII

SEQ ID NO: 1082 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCQLWCRKII

SEQ ID NO: 1083 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRYII

SEQ ID NO: 1084 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGELVCKLWCRLII

SEQ ID NO: 1085 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRKII

SEQ ID NO: 1086 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRECCEGLRCKLWCRKII

SEQ ID NO: 1087 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSARACCEGLRCKLWCRKII

SEQ ID NO: 1088 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEDLRCKLWCRKII

SEQ ID NO: 1089 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCQLWCRKII

SEQ ID NO: 1090 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRYII

SEQ ID NO: 1091 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRLII

SEQ ID NO: 1092 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSARACCEGLRCKLWCRKII

SEQ ID NO: 1093 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEDLRCKLWCRKII

SEQ ID NO: 1094 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLVCKLWCRKII

SEQ ID NO: 1095 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCQLWCRKII

SEQ ID NO: 1096 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCKLWCRYII

SEQ ID NO: 1097 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GECQKWLWTCDSKRACCEGLRCKLWCRLII

SEQ ID NO: 1098 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEARACCEGLRCKLWCRKII

SEQ ID NO: 1099 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEDLRCKLWCRKII

SEQ ID NO: 1100 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLVCKLWCRKII

SEQ ID NO: 1101 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCQLWCRKII

SEQ ID NO: 1102 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRYII

SEQ ID NO: 1103 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEKRACCEGLRCKLWCRLII

SEQ ID NO: 1104 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEDLRCKLWCRKII

SEQ ID NO: 1105 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLVCKLWCRKII

SEQ ID NO: 1106 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCQLWCRKII

SEQ ID NO: 1107 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRYII

SEQ ID NO: 1108 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRLII

SEQ ID NO: 1109 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSAEACCEGLRCKLWCRKII

SEQ ID NO: 1110 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEDLRCKLWCRKII

SEQ ID NO: 1111 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLVCKLWCRKII

SEQ ID NO: 1112 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCQLWCRKII

SEQ ID NO: 1113 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCKLWCRYII

SEQ ID NO: 1114 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKEACCEGLRCKLWCRLII

SEQ ID NO: 1115 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSARACCEGLVCKLWCRKII

SEQ ID NO: 1116 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEDLVCKLWCRKII

SEQ ID NO: 1117 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCQLWCRKII

SEQ ID NO: 1118 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCKLWCRYII

SEQ ID NO: 1119 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLVCKLWCRLII

SEQ ID NO: 1120 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRKII

SEQ ID NO: 1121 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEDLRCKLWCRKII

SEQ ID NO: 1122 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRKII

SEQ ID NO: 1123 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCQLWCRKII

SEQ ID NO: 1124 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRYII

SEQ ID NO: 1125 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLRCKLWCRLII

SEQ ID NO: 1126 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCQLWCRKII

SEQ ID NO: 1127 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRYII

SEQ ID NO: 1128 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDEERACCEGLVCKLWCRLII

SEQ ID NO: 1129 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRKII

SEQ ID NO: 1130 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCQLWCRKII

SEQ ID NO: 1131 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCKLWCRYII

SEQ ID NO: 1132 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELRCKLWCRLII

SEQ ID NO: 1133 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCQLWCRKII

SEQ ID NO: 1134 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRYII

SEQ ID NO: 1135 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEELVCKLWCRLII

SEQ ID NO: 1136 - protein, 30 aa, Artificial Sequence; identical to SEQ ID NO: 765
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1137 - protein, 30 aa, Artificial Sequence; identical to SEQ ID NO: 732
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1138 - protein, 30 aa, Artificial Sequence; identical to SEQ ID NO: 733
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1139 - protein, 30 aa, Artificial Sequence; identical to SEQ ID NO: 819
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1140 - protein, 30 aa, Artificial Sequence; identical to SEQ ID NO: 820
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1141 - protein, 30 aa, Artificial Sequence; identical to SEQ ID NO: 821
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1142 - protein, 30 aa, Artificial Sequence; identical to SEQ ID NO: 822
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1143 - protein, 30 aa, Artificial Sequence; identical to SEQ ID NO: 823
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1144 - protein, 30 aa, Artificial Sequence; identical to SEQ ID NO: 824
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1145 - protein, 30 aa, Artificial Sequence; identical to SEQ ID NO: 941
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1146 - protein, 30 aa, Artificial Sequence; identical to SEQ ID NO: 942
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1147 - protein, 30 aa, Artificial Sequence; identical to SEQ ID NO: 943
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1148 - protein, 30 aa, Artificial Sequence; identical to SEQ ID NO: 944
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1149 - protein, 30 aa, Artificial Sequence; identical to SEQ ID NO: 945
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1150 - protein, 30 aa, Artificial Sequence; identical to SEQ ID NO: 946
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1151 - protein, 30 aa, Artificial Sequence; identical to SEQ ID NO: 947
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1152 - protein, 30 aa, Artificial Sequence; identical to SEQ ID NO: 948
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1153 - protein, 30 aa, Artificial Sequence; identical to SEQ ID NO: 949
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1154 - protein, 30 aa, Artificial Sequence; identical to SEQ ID NO: 950
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1155 - protein, 30 aa, Artificial Sequence; identical to SEQ ID NO: 951
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1156 - protein, 30 aa, Artificial Sequence; identical to SEQ ID NO: 952
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1157 - protein, 30 aa, Artificial Sequence; identical to SEQ ID NO: 953
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1158 - protein, 30 aa, Artificial Sequence; identical to SEQ ID NO: 954
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1159 - protein, 30 aa, Artificial Sequence; identical to SEQ ID NO: 955
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1160 - protein, 30 aa, Artificial Sequence; identical to SEQ ID NO: 956
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1161 - protein, 30 aa, Artificial Sequence; identical to SEQ ID NO: 957
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1162 - protein, 30 aa, Artificial Sequence; identical to SEQ ID NO: 958
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1163 - protein, 30 aa, Artificial Sequence; identical to SEQ ID NO: 959
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1164 - protein, 30 aa, Artificial Sequence; identical to SEQ ID NO: 960
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1165 - protein, 30 aa, Artificial Sequence; identical to SEQ ID NO: 961
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1166 - protein, 30 aa, Artificial Sequence; identical to SEQ ID NO: 962
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1167 - protein, 30 aa, Artificial Sequence; identical to SEQ ID NO: 963
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1168 - protein, 30 aa, Artificial Sequence; identical to SEQ ID NO: 964
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1169 - protein, 30 aa, Artificial Sequence; identical to SEQ ID NO: 965
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1170 - protein, 30 aa, Artificial Sequence; identical to SEQ ID NO: 966
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1171 - protein, 30 aa, Artificial Sequence; identical to SEQ ID NO: 967
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1172 - protein, 30 aa, Artificial Sequence; identical to SEQ ID NO: 968
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1173 - protein, 30 aa, Artificial Sequence; identical to SEQ ID NO: 969
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1174 - protein, 30 aa, Artificial Sequence; identical to SEQ ID NO: 970
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1175 - protein, 30 aa, Artificial Sequence; identical to SEQ ID NO: 971
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1176 - protein, 30 aa, Artificial Sequence; identical to SEQ ID NO: 972
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1177 - protein, 30 aa, Artificial Sequence; identical to SEQ ID NO: 973
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1178 - protein, 30 aa, Artificial Sequence; identical to SEQ ID NO: 974
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1179 - protein, 30 aa, Artificial Sequence; identical to SEQ ID NO: 975
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1180 - protein, 30 aa, Artificial Sequence; identical to SEQ ID NO: 976
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1181 - protein, 30 aa, Artificial Sequence; identical to SEQ ID NO: 977
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1182 - protein, 30 aa, Artificial Sequence; identical to SEQ ID NO: 978
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1183 - protein, 30 aa, Artificial Sequence; identical to SEQ ID NO: 979
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1184 - protein, 30 aa, Artificial Sequence; identical to SEQ ID NO: 980
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1185 - protein, 30 aa, Artificial Sequence; identical to SEQ ID NO: 981
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1186 - protein, 30 aa, Artificial Sequence; identical to SEQ ID NO: 982
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1187 - protein, 30 aa, Artificial Sequence; identical to SEQ ID NO: 983
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1188 - protein, 30 aa, Artificial Sequence; identical to SEQ ID NO: 984
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1189 - protein, 30 aa, Artificial Sequence; identical to SEQ ID NO: 985
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1190 - protein, 30 aa, Artificial Sequence; identical to SEQ ID NO: 714
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1191 - protein, 30 aa, Artificial Sequence; identical to SEQ ID NO: 715
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1192 - protein, 30 aa, Artificial Sequence; identical to SEQ ID NO: 717
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1193 - protein, 30 aa, Artificial Sequence; identical to SEQ ID NO: 986
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1194 - protein, 30 aa, Artificial Sequence; identical to SEQ ID NO: 987
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1195 - protein, 30 aa, Artificial Sequence; identical to SEQ ID NO: 645
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1196 - protein, 30 aa, Artificial Sequence; identical to SEQ ID NO: 780
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1197 - protein, 30 aa, Artificial Sequence; identical to SEQ ID NO: 988
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1198 - protein, 30 aa, Artificial Sequence; identical to SEQ ID NO: 989
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1199 - protein, 30 aa, Artificial Sequence; identical to SEQ ID NO: 990
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1200 - protein, 30 aa, Artificial Sequence; identical to SEQ ID NO: 991
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1201 - protein, 30 aa, Artificial Sequence; identical to SEQ ID NO: 992
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1202 - protein, 30 aa, Artificial Sequence; identical to SEQ ID NO: 993
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1203 - protein, 30 aa, Artificial Sequence; identical to SEQ ID NO: 994
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1204 - protein, 30 aa, Artificial Sequence; identical to SEQ ID NO: 995
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1205 - protein, 30 aa, Artificial Sequence; identical to SEQ ID NO: 996
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1206 - protein, 30 aa, Artificial Sequence; identical to SEQ ID NO: 997
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1207 - protein, 30 aa, Artificial Sequence; identical to SEQ ID NO: 998
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1208 - protein, 30 aa, Artificial Sequence; identical to SEQ ID NO: 999
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1209 - protein, 30 aa, Artificial Sequence; identical to SEQ ID NO: 1000
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1210 - protein, 30 aa, Artificial Sequence; identical to SEQ ID NO: 1001
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1211 - protein, 30 aa, Artificial Sequence; identical to SEQ ID NO: 1002
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1212 - protein, 30 aa, Artificial Sequence; identical to SEQ ID NO: 1003
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1213 - protein, 30 aa, Artificial Sequence; identical to SEQ ID NO: 1004
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1214 - protein, 30 aa, Artificial Sequence; identical to SEQ ID NO: 1005
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1215 - protein, 30 aa, Artificial Sequence; identical to SEQ ID NO: 1006
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1216 - protein, 30 aa, Artificial Sequence; identical to SEQ ID NO: 1007
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1217 - protein, 30 aa, Artificial Sequence; identical to SEQ ID NO: 1008
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1218 - protein, 30 aa, Artificial Sequence; identical to SEQ ID NO: 1009
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1219 - protein, 30 aa, Artificial Sequence; identical to SEQ ID NO: 1010
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1220 - protein, 30 aa, Artificial Sequence; identical to SEQ ID NO: 1011
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1221 - protein, 30 aa, Artificial Sequence; identical to SEQ ID NO: 1012
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1222 - protein, 30 aa, Artificial Sequence; identical to SEQ ID NO: 1013
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1223 - protein, 30 aa, Artificial Sequence; identical to SEQ ID NO: 1014
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1224 - protein, 30 aa, Artificial Sequence; identical to SEQ ID NO: 1015
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1225 - protein, 30 aa, Artificial Sequence; identical to SEQ ID NO: 1016
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1226 - protein, 30 aa, Artificial Sequence; identical to SEQ ID NO: 1017
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1227 - protein, 30 aa, Artificial Sequence; identical to SEQ ID NO: 744
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1228 - protein, 30 aa, Artificial Sequence; identical to SEQ ID NO: 1018
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1229 - protein, 30 aa, Artificial Sequence; identical to SEQ ID NO: 1019
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1230 - protein, 30 aa, Artificial Sequence; identical to SEQ ID NO: 1020
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1231 - protein, 30 aa, Artificial Sequence; identical to SEQ ID NO: 1021
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1232 - protein, 30 aa, Artificial Sequence; identical to SEQ ID NO: 1022
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1233 - protein, 30 aa, Artificial Sequence; identical to SEQ ID NO: 1023
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1234 - protein, 30 aa, Artificial Sequence; identical to SEQ ID NO: 1024
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1235 - protein, 30 aa, Artificial Sequence; identical to SEQ ID NO: 1025
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1236 - protein, 30 aa, Artificial Sequence; identical to SEQ ID NO: 1026
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1237 - protein, 30 aa, Artificial Sequence; identical to SEQ ID NO: 1027
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1238 - protein, 30 aa, Artificial Sequence; identical to SEQ ID NO: 1028
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1239 - protein, 30 aa, Artificial Sequence; identical to SEQ ID NO: 1029
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1240 - protein, 30 aa, Artificial Sequence; identical to SEQ ID NO: 1030
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1241 - protein, 30 aa, Artificial Sequence; identical to SEQ ID NO: 1031
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1242 - protein, 30 aa, Artificial Sequence; identical to SEQ ID NO: 1032
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1243 - protein, 30 aa, Artificial Sequence; identical to SEQ ID NO: 1033
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1244 - protein, 30 aa, Artificial Sequence; identical to SEQ ID NO: 1034
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1245 - protein, 30 aa, Artificial Sequence; identical to SEQ ID NO: 759
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1246 - protein, 30 aa, Artificial Sequence; identical to SEQ ID NO: 760
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1247 - protein, 30 aa, Artificial Sequence; identical to SEQ ID NO: 1035
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1248 - protein, 30 aa, Artificial Sequence; identical to SEQ ID NO: 1036
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1249 - protein, 30 aa, Artificial Sequence; identical to SEQ ID NO: 1037
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1250 - protein, 30 aa, Artificial Sequence; identical to SEQ ID NO: 1038
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1251 - protein, 30 aa, Artificial Sequence; identical to SEQ ID NO: 1039
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1252 - protein, 30 aa, Artificial Sequence; identical to SEQ ID NO: 1040
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1253 - protein, 30 aa, Artificial Sequence; identical to SEQ ID NO: 1041
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1254 - protein, 30 aa, Artificial Sequence; identical to SEQ ID NO: 1042
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1255 - protein, 30 aa, Artificial Sequence; identical to SEQ ID NO: 1043
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1256 - protein, 30 aa, Artificial Sequence; identical to SEQ ID NO: 1044
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1257 - protein, 30 aa, Artificial Sequence; identical to SEQ ID NO: 1045
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1258 - protein, 30 aa, Artificial Sequence; identical to SEQ ID NO: 1046
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1259 - protein, 30 aa, Artificial Sequence; identical to SEQ ID NO: 1047
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1260 - protein, 30 aa, Artificial Sequence; identical to SEQ ID NO: 1048
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1261 - protein, 30 aa, Artificial Sequence; identical to SEQ ID NO: 1049
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1262 - protein, 30 aa, Artificial Sequence; identical to SEQ ID NO: 1050
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1263 - protein, 30 aa, Artificial Sequence; identical to SEQ ID NO: 1051
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1264 - protein, 30 aa, Artificial Sequence; identical to SEQ ID NO: 1052
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1265 - protein, 30 aa, Artificial Sequence; identical to SEQ ID NO: 1053
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1266 - protein, 30 aa, Artificial Sequence; identical to SEQ ID NO: 1054
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1267 - protein, 30 aa, Artificial Sequence; identical to SEQ ID NO: 1055
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1268 - protein, 30 aa, Artificial Sequence; identical to SEQ ID NO: 1056
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1269 - protein, 30 aa, Artificial Sequence; identical to SEQ ID NO: 1057
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1270 - protein, 30 aa, Artificial Sequence; identical to SEQ ID NO: 1058
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1271 - protein, 30 aa, Artificial Sequence; identical to SEQ ID NO: 1059
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1272 - protein, 30 aa, Artificial Sequence; identical to SEQ ID NO: 1060
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1273 - protein, 30 aa, Artificial Sequence; identical to SEQ ID NO: 1061
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1274 - protein, 30 aa, Artificial Sequence; identical to SEQ ID NO: 1062
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1275 - protein, 30 aa, Artificial Sequence; identical to SEQ ID NO: 1063
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1276 - protein, 30 aa, Artificial Sequence; identical to SEQ ID NO: 1064
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1277 - protein, 30 aa, Artificial Sequence; identical to SEQ ID NO: 1065
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1278 - protein, 30 aa, Artificial Sequence; identical to SEQ ID NO: 1066
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1279 - protein, 30 aa, Artificial Sequence; identical to SEQ ID NO: 1067
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1280 - protein, 30 aa, Artificial Sequence; identical to SEQ ID NO: 1068
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1281 - protein, 30 aa, Artificial Sequence; identical to SEQ ID NO: 1069
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1282 - protein, 30 aa, Artificial Sequence; identical to SEQ ID NO: 1070
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1283 - protein, 30 aa, Artificial Sequence; identical to SEQ ID NO: 1071
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1284 - protein, 30 aa, Artificial Sequence; identical to SEQ ID NO: 1072
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1285 - protein, 30 aa, Artificial Sequence; identical to SEQ ID NO: 1073
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1286 - protein, 30 aa, Artificial Sequence; identical to SEQ ID NO: 1074
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1287 - protein, 30 aa, Artificial Sequence; identical to SEQ ID NO: 1075
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1288 - protein, 30 aa, Artificial Sequence; identical to SEQ ID NO: 1076
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1289 - protein, 30 aa, Artificial Sequence; identical to SEQ ID NO: 1077
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1290 - protein, 30 aa, Artificial Sequence; identical to SEQ ID NO: 1078
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1291 - protein, 30 aa, Artificial Sequence; identical to SEQ ID NO: 1079
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1292 - protein, 30 aa, Artificial Sequence; identical to SEQ ID NO: 1080
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1293 - protein, 30 aa, Artificial Sequence; identical to SEQ ID NO: 1081
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1294 - protein, 30 aa, Artificial Sequence; identical to SEQ ID NO: 1082
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1295 - protein, 30 aa, Artificial Sequence; identical to SEQ ID NO: 1083
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1296 - protein, 30 aa, Artificial Sequence; identical to SEQ ID NO: 1084
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1297 - protein, 30 aa, Artificial Sequence; identical to SEQ ID NO: 1085
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1298 - protein, 30 aa, Artificial Sequence; identical to SEQ ID NO: 730
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1299 - protein, 30 aa, Artificial Sequence; identical to SEQ ID NO: 1086
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1300 - protein, 30 aa, Artificial Sequence; identical to SEQ ID NO: 1087
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1301 - protein, 30 aa, Artificial Sequence; identical to SEQ ID NO: 1088
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1302 - protein, 30 aa, Artificial Sequence; identical to SEQ ID NO: 628
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1303 - protein, 30 aa, Artificial Sequence; identical to SEQ ID NO: 1089
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1304 - protein, 30 aa, Artificial Sequence; identical to SEQ ID NO: 1090
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1305 - protein, 30 aa, Artificial Sequence; identical to SEQ ID NO: 1091
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1306 - protein, 30 aa, Artificial Sequence; identical to SEQ ID NO: 1092
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1307 - protein, 30 aa, Artificial Sequence; identical to SEQ ID NO: 1093
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1308 - protein, 30 aa, Artificial Sequence; identical to SEQ ID NO: 1094
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1309 - protein, 30 aa, Artificial Sequence; identical to SEQ ID NO: 1095
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1310 - protein, 30 aa, Artificial Sequence; identical to SEQ ID NO: 1096
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1311 - protein, 30 aa, Artificial Sequence; identical to SEQ ID NO: 1097
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1312 - protein, 30 aa, Artificial Sequence; identical to SEQ ID NO: 1098
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1313 - protein, 30 aa, Artificial Sequence; identical to SEQ ID NO: 1099
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1314 - protein, 30 aa, Artificial Sequence; identical to SEQ ID NO: 1100
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1315 - protein, 30 aa, Artificial Sequence; identical to SEQ ID NO: 1101
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1316 - protein, 30 aa, Artificial Sequence; identical to SEQ ID NO: 1102
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1317 - protein, 30 aa, Artificial Sequence; identical to SEQ ID NO: 1103
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1318 - protein, 30 aa, Artificial Sequence; identical to SEQ ID NO: 1104
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1319 - protein, 30 aa, Artificial Sequence; identical to SEQ ID NO: 1105
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1320 - protein, 30 aa, Artificial Sequence; identical to SEQ ID NO: 1106
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1321 - protein, 30 aa, Artificial Sequence; identical to SEQ ID NO: 1107
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1322 - protein, 30 aa, Artificial Sequence; identical to SEQ ID NO: 1108
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1323 - protein, 30 aa, Artificial Sequence; identical to SEQ ID NO: 1109
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1324 - protein, 30 aa, Artificial Sequence; identical to SEQ ID NO: 1110
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1325 - protein, 30 aa, Artificial Sequence; identical to SEQ ID NO: 1111
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1326 - protein, 30 aa, Artificial Sequence; identical to SEQ ID NO: 1112
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1327 - protein, 30 aa, Artificial Sequence; identical to SEQ ID NO: 1113
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1328 - protein, 30 aa, Artificial Sequence; identical to SEQ ID NO: 1114
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1329 - protein, 30 aa, Artificial Sequence; identical to SEQ ID NO: 1115
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1330 - protein, 30 aa, Artificial Sequence; identical to SEQ ID NO: 1116
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1331 - protein, 30 aa, Artificial Sequence; identical to SEQ ID NO: 1117
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1332 - protein, 30 aa, Artificial Sequence; identical to SEQ ID NO: 1118
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1333 - protein, 30 aa, Artificial Sequence; identical to SEQ ID NO: 1119
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1334 - protein, 30 aa, Artificial Sequence; identical to SEQ ID NO: 1120
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1335 - protein, 30 aa, Artificial Sequence; identical to SEQ ID NO: 1121
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1336 - protein, 30 aa, Artificial Sequence; identical to SEQ ID NO: 1122
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1337 - protein, 30 aa, Artificial Sequence; identical to SEQ ID NO: 1123
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1338 - protein, 30 aa, Artificial Sequence; identical to SEQ ID NO: 1124
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1339 - protein, 30 aa, Artificial Sequence; identical to SEQ ID NO: 1125
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1340 - protein, 30 aa, Artificial Sequence; identical to SEQ ID NO: 1126
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1341 - protein, 30 aa, Artificial Sequence; identical to SEQ ID NO: 1127
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1342 - protein, 30 aa, Artificial Sequence; identical to SEQ ID NO: 1128
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1343 - protein, 30 aa, Artificial Sequence; identical to SEQ ID NO: 1129
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1344 - protein, 30 aa, Artificial Sequence; identical to SEQ ID NO: 1130
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1345 - protein, 30 aa, Artificial Sequence; identical to SEQ ID NO: 1131
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1346 - protein, 30 aa, Artificial Sequence; identical to SEQ ID NO: 1132
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1347 - protein, 30 aa, Artificial Sequence; identical to SEQ ID NO: 1133
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1348 - protein, 30 aa, Artificial Sequence; identical to SEQ ID NO: 1134
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1349 - protein, 30 aa, Artificial Sequence; identical to SEQ ID NO: 1135
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1350 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLRCKLWCRKEI

SEQ ID NO: 1351 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELRCKLWCRKEI

SEQ ID NO: 1352 - protein, 30 aa, Artificial Sequence; identical to SEQ ID NO: 709
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"

SEQ ID NO: 1353 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELRCKLWCRKEI

SEQ ID NO: 1354 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLRCKLWCRKII

SEQ ID NO: 1355 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELRCKLWCRKII

SEQ ID NO: 1356 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GECQKWLWTCDSKRACCEGLRCKLWCRKII

SEQ ID NO: 1357 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELRCKLWCRKII

SEQ ID NO: 1358 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AECQKFLWTCDSKRACCGGLRCKLWCRKEI

SEQ ID NO: 1359 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEKRACCGGLRCKLWCRKEI

SEQ ID NO: 1360 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGGLRCKLWCRKEI

SEQ ID NO: 1361 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSKRECCGGLRCKLWCRKEI

SEQ ID NO: 1362 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEERACCGGLRCKLWCRKEI

SEQ ID NO: 1363 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGELRCKLWCRKEI

SEQ ID NO: 1364 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GECQKFLWTCDSKRACCEGLRCKLWCRKEI

SEQ ID NO: 1365 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEKRACCEGLRCKLWCRKEI

SEQ ID NO: 1366 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEGLRCKLWCRKEI

SEQ ID NO: 1367 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSKRECCEGLRCKLWCRKEI

SEQ ID NO: 1368 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEERACCEGLRCKLWCRKEI

SEQ ID NO: 1369 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEELRCKLWCRKEI

SEQ ID NO: 1370 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AECQKFLWTCDSKRACCGGLRCKLWCRKII

SEQ ID NO: 1371 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEKRACCGGLRCKLWCRKII

SEQ ID NO: 1372 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGGLRCKLWCRKII

SEQ ID NO: 1373 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSKRECCGGLRCKLWCRKII

SEQ ID NO: 1374 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEERACCGGLRCKLWCRKII

SEQ ID NO: 1375 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGELRCKLWCRKII

SEQ ID NO: 1376 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GECQKFLWTCDSKRACCEGLRCKLWCRKII

SEQ ID NO: 1377 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEKRACCEGLRCKLWCRKII

SEQ ID NO: 1378 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEGLRCKLWCRKII

SEQ ID NO: 1379 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSKRECCEGLRCKLWCRKII

SEQ ID NO: 1380 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEERACCEGLRCKLWCRKII

SEQ ID NO: 1381 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEELRCKLWCRKII

SEQ ID NO: 1382 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AECQKWLWTCDSKRACCGGLRCKGWCRKEI

SEQ ID NO: 1383 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEKRACCGGLRCKGWCRKEI

SEQ ID NO: 1384 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGGLRCKGWCRKEI

SEQ ID NO: 1385 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSKRECCGGLRCKGWCRKEI

SEQ ID NO: 1386 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEERACCGGLRCKGWCRKEI

SEQ ID NO: 1387 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGELRCKGWCRKEI

SEQ ID NO: 1388 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GECQKWLWTCDSKRACCEGLRCKGWCRKEI

SEQ ID NO: 1389 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEKRACCEGLRCKGWCRKEI

SEQ ID NO: 1390 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEGLRCKGWCRKEI

SEQ ID NO: 1391 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSKRECCEGLRCKGWCRKEI

SEQ ID NO: 1392 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEERACCEGLRCKGWCRKEI

SEQ ID NO: 1393 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEELRCKGWCRKEI

SEQ ID NO: 1394 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AECQKWLWTCDSKRACCGGLRCKGWCRKII

SEQ ID NO: 1395 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEKRACCGGLRCKGWCRKII

SEQ ID NO: 1396 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGGLRCKGWCRKII

SEQ ID NO: 1397 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSKRECCGGLRCKGWCRKII

SEQ ID NO: 1398 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEERACCGGLRCKGWCRKII

SEQ ID NO: 1399 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGELRCKGWCRKII

SEQ ID NO: 1400 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GECQKWLWTCDSKRACCEGLRCKGWCRKII

SEQ ID NO: 1401 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEKRACCEGLRCKGWCRKII

SEQ ID NO: 1402 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEGLRCKGWCRKII

SEQ ID NO: 1403 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSKRECCEGLRCKGWCRKII

SEQ ID NO: 1404 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEERACCEGLRCKGWCRKII

SEQ ID NO: 1405 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEELRCKGWCRKII

SEQ ID NO: 1406 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLRCKLWCRKEF

SEQ ID NO: 1407 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEKRACCGGLRCKLWCRKEF

SEQ ID NO: 1408 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGGLRCKLWCRKEF

SEQ ID NO: 1409 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSKRECCGGLRCKLWCRKEF

SEQ ID NO: 1410 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEERACCGGLRCKLWCRKEF

SEQ ID NO: 1411 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELRCKLWCRKEF

SEQ ID NO: 1412 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GECQKWLWTCDSKRACCEGLRCKLWCRKEF

SEQ ID NO: 1413 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEKRACCEGLRCKLWCRKEF

SEQ ID NO: 1414 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEGLRCKLWCRKEF

SEQ ID NO: 1415 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLRCKLWCRKEF

SEQ ID NO: 1416 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEERACCEGLRCKLWCRKEF

SEQ ID NO: 1417 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELRCKLWCRKEF

SEQ ID NO: 1418 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLRCKLWCRKIF

SEQ ID NO: 1419 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEKRACCGGLRCKLWCRKIF

SEQ ID NO: 1420 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGGLRCKLWCRKIF

SEQ ID NO: 1421 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSKRECCGGLRCKLWCRKIF

SEQ ID NO: 1422 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEERACCGGLRCKLWCRKIF

SEQ ID NO: 1423 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELRCKLWCRKIF

SEQ ID NO: 1424 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GECQKWLWTCDSKRACCEGLRCKLWCRKIF

SEQ ID NO: 1425 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEKRACCEGLRCKLWCRKIF

SEQ ID NO: 1426 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEGLRCKLWCRKIF

SEQ ID NO: 1427 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLRCKLWCRKIF

SEQ ID NO: 1428 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEERACCEGLRCKLWCRKIF

SEQ ID NO: 1429 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELRCKLWCRKIF

SEQ ID NO: 1430 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLVCKLWCRKEI

SEQ ID NO: 1431 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLVCKLWCRKII

SEQ ID NO: 1432 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AECQKFLWTCDSKRACCGGLVCKLWCRKEI

SEQ ID NO: 1433 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEKRACCGGLVCKLWCRKEI

SEQ ID NO: 1434 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGGLVCKLWCRKEI

SEQ ID NO: 1435 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSKRECCGGLVCKLWCRKEI

SEQ ID NO: 1436 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEERACCGGLVCKLWCRKEI

SEQ ID NO: 1437 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGELVCKLWCRKEI

SEQ ID NO: 1438 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GECQKFLWTCDSKRACCEGLVCKLWCRKEI

SEQ ID NO: 1439 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEKRACCEGLVCKLWCRKEI

SEQ ID NO: 1440 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEGLVCKLWCRKEI

SEQ ID NO: 1441 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSKRECCEGLVCKLWCRKEI

SEQ ID NO: 1442 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEERACCEGLVCKLWCRKEI

SEQ ID NO: 1443 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEELVCKLWCRKEI

SEQ ID NO: 1444 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AECQKFLWTCDSKRACCGGLVCKLWCRKII

SEQ ID NO: 1445 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEKRACCGGLVCKLWCRKII

SEQ ID NO: 1446 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGGLVCKLWCRKII

SEQ ID NO: 1447 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSKRECCGGLVCKLWCRKII

SEQ ID NO: 1448 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDEERACCGGLVCKLWCRKII

SEQ ID NO: 1449 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
AYCQKFLWTCDSERACCGELVCKLWCRKII

SEQ ID NO: 1450 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GECQKFLWTCDSKRACCEGLVCKLWCRKII

SEQ ID NO: 1451 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEKRACCEGLVCKLWCRKII

SEQ ID NO: 1452 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEGLVCKLWCRKII

SEQ ID NO: 1453 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSKRECCEGLVCKLWCRKII

SEQ ID NO: 1454 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDEERACCEGLVCKLWCRKII

SEQ ID NO: 1455 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSERACCEELVCKLWCRKII

SEQ ID NO: 1456 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AECQKWLWTCDSKRACCGGLVCKGWCRKEI

SEQ ID NO: 1457 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEKRACCGGLVCKGWCRKEI

SEQ ID NO: 1458 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGGLVCKGWCRKEI

SEQ ID NO: 1459 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSKRECCGGLVCKGWCRKEI

SEQ ID NO: 1460 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEERACCGGLVCKGWCRKEI

SEQ ID NO: 1461 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGELVCKGWCRKEI

SEQ ID NO: 1462 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GECQKWLWTCDSKRACCEGLVCKGWCRKEI

SEQ ID NO: 1463 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEKRACCEGLVCKGWCRKEI

SEQ ID NO: 1464 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEGLVCKGWCRKEI

SEQ ID NO: 1465 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSKRECCEGLVCKGWCRKEI

SEQ ID NO: 1466 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEERACCEGLVCKGWCRKEI

SEQ ID NO: 1467 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEELVCKGWCRKEI

SEQ ID NO: 1468 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AECQKWLWTCDSKRACCGGLVCKGWCRKII

SEQ ID NO: 1469 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEKRACCGGLVCKGWCRKII

SEQ ID NO: 1470 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGGLVCKGWCRKII

SEQ ID NO: 1471 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSKRECCGGLVCKGWCRKII

SEQ ID NO: 1472 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDEERACCGGLVCKGWCRKII

SEQ ID NO: 1473 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSERACCGELVCKGWCRKII

SEQ ID NO: 1474 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GECQKWLWTCDSKRACCEGLVCKGWCRKII

SEQ ID NO: 1475 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEKRACCEGLVCKGWCRKII

SEQ ID NO: 1476 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEGLVCKGWCRKII

SEQ ID NO: 1477 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSKRECCEGLVCKGWCRKII

SEQ ID NO: 1478 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDEERACCEGLVCKGWCRKII

SEQ ID NO: 1479 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  MOD_RES (25)..(25): 5-Br-Trp
  source: /note="C-term Amide"
GYCQKWLWTCDSERACCEELVCKGWCRKII

SEQ ID NO: 1480 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLVCKLWCRKEF

SEQ ID NO: 1481 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEKRACCGGLVCKLWCRKEF

SEQ ID NO: 1482 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGGLVCKLWCRKEF

SEQ ID NO: 1483 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSKRECCGGLVCKLWCRKEF

SEQ ID NO: 1484 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEERACCGGLVCKLWCRKEF

SEQ ID NO: 1485 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELVCKLWCRKEF

SEQ ID NO: 1486 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GECQKWLWTCDSKRACCEGLVCKLWCRKEF

SEQ ID NO: 1487 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEKRACCEGLVCKLWCRKEF

SEQ ID NO: 1488 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEGLVCKLWCRKEF

SEQ ID NO: 1489 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLVCKLWCRKEF

SEQ ID NO: 1490 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEERACCEGLVCKLWCRKEF

SEQ ID NO: 1491 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELVCKLWCRKEF

SEQ ID NO: 1492 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AECQKWLWTCDSKRACCGGLVCKLWCRKIF

SEQ ID NO: 1493 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEKRACCGGLVCKLWCRKIF

SEQ ID NO: 1494 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGGLVCKLWCRKIF

SEQ ID NO: 1495 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSKRECCGGLVCKLWCRKIF

SEQ ID NO: 1496 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDEERACCGGLVCKLWCRKIF

SEQ ID NO: 1497 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"
AYCQKWLWTCDSERACCGELVCKLWCRKIF

SEQ ID NO: 1498 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GECQKWLWTCDSKRACCEGLVCKLWCRKIF

SEQ ID NO: 1499 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEKRACCEGLVCKLWCRKIF

SEQ ID NO: 1500 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEGLVCKLWCRKIF

SEQ ID NO: 1501 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSKRECCEGLVCKLWCRKIF

SEQ ID NO: 1502 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDEERACCEGLVCKLWCRKIF

SEQ ID NO: 1503 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term Amide"
GYCQKWLWTCDSERACCEELVCKLWCRKIF

SEQ ID NO: 1504 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): hPra
  MOD_RES (7)..(7): Nle
  source: /note="C-term Amide"

SEQ ID NO: 1505 - protein, 30 aa, Artificial Sequence; identical to SEQ ID NO: 391
  source: /note="Description of Artificial Sequence: Synthetic polypeptide"
  source: /note="N-term Amino group"
  MOD_RES (1)..(1): CyA
  MOD_RES (2)..(2): hPra
  MOD_RES (7)..(7): Nle
  source: /note="C-term Amide"

SEQ ID NO: 1506 - protein, 30 aa, Artificial Sequence; identical to SEQ ID NO: 389
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): hPra
  source: /note="C-term Amide"

SEQ ID NO: 1507 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): hPra
  source: /note="C-term Amide"
AYCQKWLWTCDSGRACCEGLRCKLWCRKII

SEQ ID NO: 1508 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): hPra
  source: /note="C-term Amide"
AYCQKWLWTCDSKRGCCEGLRCKLWCRKII

SEQ ID NO: 1509 - protein, 30 aa, Artificial Sequence; identical to SEQ ID NO: 388
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): hPra
  source: /note="C-term Amide"

SEQ ID NO: 1510 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): hPra
  MOD_RES (7)..(7): Nle
  source: /note="C-term Amide"

SEQ ID NO: 1511 - protein, 30 aa, Artificial Sequence; identical to SEQ ID NO: 518
  source: /note="Description of Artificial Sequence: Synthetic polypeptide"
  source: /note="N-term Amino group"
  MOD_RES (1)..(1): CyA
  MOD_RES (2)..(2): hPra
  MOD_RES (7)..(7): Nle
  source: /note="C-term Amide"

SEQ ID NO: 1512 - protein, 30 aa, Artificial Sequence; identical to SEQ ID NO: 520
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): hPra
  source: /note="C-term Amide"

SEQ ID NO: 1513 - protein, 30 aa, Artificial Sequence; identical to SEQ ID NO: 521
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): hPra
  source: /note="C-term Amide"

SEQ ID NO: 1514 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): hPra
  source: /note="C-term Amide"
AYCQKWLWTCDSKRGCCEGLRCKLWCRKEI

SEQ ID NO: 1515 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): hPra
  source: /note="C-term Amide"

SEQ ID NO: 1516 - protein, 30 aa, Artificial Sequence; identical to SEQ ID NO: 359
  source: /note="Description of Artificial Sequence: Synthetic polypeptide"
  source: /note="N-term Amino group"
  MOD_RES (1)..(1): BhPra
  MOD_RES (7)..(7): Nle
  source: /note="C-term Amide"

SEQ ID NO: 1517 - protein, 30 aa, Artificial Sequence; identical to SEQ ID NO: 391
  source: /note="Description of Artificial Sequence: Synthetic polypeptide"
  source: /note="N-term Amino group"
  MOD_RES (1)..(1): CyA
  MOD_RES (2)..(2): BhPra
  MOD_RES (7)..(7): Nle
  source: /note="C-term Amide"

SEQ ID NO: 1518 - protein, 30 aa, Artificial Sequence; identical to SEQ ID NO: 389
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): BhPra
  source: /note="C-term Amide"

SEQ ID NO: 1519 - protein, 30 aa, Artificial Sequence; identical to SEQ ID NO: 1507
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): BhPra
  source: /note="C-term Amide"

SEQ ID NO: 1520 - protein, 30 aa, Artificial Sequence; identical to SEQ ID NO: 1508
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): BhPra
  source: /note="C-term Amide"

SEQ ID NO: 1521 - protein, 30 aa, Artificial Sequence; identical to SEQ ID NO: 388
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): BhPra
  source: /note="C-term Amide"

SEQ ID NO: 1522 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): BhPra
  MOD_RES (7)..(7): Nle
  source: /note="C-term Amide"

SEQ ID NO: 1523 - protein, 30 aa, Artificial Sequence; identical to SEQ ID NO: 518
  source: /note="Description of Artificial Sequence: Synthetic polypeptide"
  source: /note="N-term Amino group"
  MOD_RES (1)..(1): CyA
  MOD_RES (2)..(2): BhPra
  MOD_RES (7)..(7): Nle
  source: /note="C-term Amide"

SEQ ID NO: 1524 - protein, 30 aa, Artificial Sequence; identical to SEQ ID NO: 520
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): BhPra
  source: /note="C-term Amide"

SEQ ID NO: 1525 - protein, 30 aa, Artificial Sequence; identical to SEQ ID NO: 521
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): BhPra
  source: /note="C-term Amide"

SEQ ID NO: 1526 - protein, 30 aa, Artificial Sequence; identical to SEQ ID NO: 1514
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): BhPra
  source: /note="C-term Amide"

SEQ ID NO: 1527 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): BhPra
  source: /note="C-term Amide"

SEQ ID NO: 1528 - protein, 30 aa, Artificial Sequence; identical to SEQ ID NO: 358
  source: /note="Description of Artificial Sequence: Synthetic polypeptide"
  source: /note="N-term Amino group"
  MOD_RES (1)..(1): EPA
  MOD_RES (7)..(7): Nle
  source: /note="C-term Amide"

SEQ ID NO: 1529 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): EPA
  MOD_RES (7)..(7): Nle
  source: /note="C-term Amide"
AFCQKWLWTCDSKRACCEGLRCKLWCRKII

SEQ ID NO: 1530 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): EPA
  source: /note="C-term Amide"
AYCQKWLWTCDFKRACCEGLRCKLWCRKII

SEQ ID NO: 1531 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): EPA
  source: /note="C-term Amide"
AYCQKWLWTCDSFRACCEGLRCKLWCRKII

SEQ ID NO: 1532 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): EPA
  source: /note="C-term Amide"
AYCQKWLWTCDSKRFCCEGLRCKLWCRKII

SEQ ID NO: 1533 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): EPA
  source: /note="C-term Amide"
AYCQKWLWTCDSKRACCFGLRCKLWCRKII

SEQ ID NO: 1534 - protein, 30 aa, Artificial Sequence
  source: /note="Description of Artificial Sequence: Synthetic polypeptide"
  source: /note="N-term Amino group"
  MOD_RES (1)..(1): EPA
  MOD_RES (7)..(7): Nle
  source: /note="C-term Amide"
FYCQKWLWTCDSKRACCEGLRCKLWCRKEI

SEQ ID NO: 1535 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (2)..(2): EPA
  MOD_RES (7)..(7): Nle
  source: /note="C-term Amide"
AFCQKWLWTCDSKRACCEGLRCKLWCRKEI

SEQ ID NO: 1536 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): EPA
  source: /note="C-term Amide"
AYCQKWLWTCDFKRACCEGLRCKLWCRKEI

SEQ ID NO: 1537 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (13)..(13): EPA
  source: /note="C-term Amide"
AYCQKWLWTCDSFRACCEGLRCKLWCRKEI

SEQ ID NO: 1538 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (15)..(15): EPA
  source: /note="C-term Amide"
AYCQKWLWTCDSKRFCCEGLRCKLWCRKEI

SEQ ID NO: 1539 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): EPA
  source: /note="C-term Amide"
AYCQKWLWTCDSKRACCFGLRCKLWCRKEI

SEQ ID NO: 1540 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 4-Clh-Phe
  MOD_RES (7)..(7): Nle
  source: /note="C-term Amide"

SEQ ID NO: 1541 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 4-Pheh-Phe
  MOD_RES (7)..(7): Nle
  source: /note="C-term Amide"

SEQ ID NO: 1542 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 4-Meh-Phe
  MOD_RES (7)..(7): Nle
  source: /note="C-term Amide"

SEQ ID NO: 1543 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 4-MeOh-Phe
  MOD_RES (7)..(7): Nle
  source: /note="C-term Amide"

SEQ ID NO: 1544 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 3-Brh-Phe
  MOD_RES (7)..(7): Nle
  source: /note="C-term Amide"

SEQ ID NO: 1545 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 3-Clh-Phe
  MOD_RES (7)..(7): Nle
  source: /note="C-term Amide"

SEQ ID NO: 1546 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 3-Pheh-Phe
  MOD_RES (7)..(7): Nle
  source: /note="C-term Amide"

SEQ ID NO: 1547 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 3-Meh-Phe
  MOD_RES (7)..(7): Nle
  source: /note="C-term Amide"

SEQ ID NO: 1548 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 3-MeOh-Phe
  MOD_RES (7)..(7): Nle
  source: /note="C-term Amide"

SEQ ID NO: 1549 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 2-Brh-Phe
  MOD_RES (7)..(7): Nle
  source: /note="C-term Amide"

SEQ ID NO: 1550 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 2-Clh-Phe
  MOD_RES (7)..(7): Nle
  source: /note="C-term Amide"

SEQ ID NO: 1551 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 2-Pheh-Phe
  MOD_RES (7)..(7): Nle
  source: /note="C-term Amide"

SEQ ID NO: 1552 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 2-Meh-Phe
  MOD_RES (7)..(7): Nle
  source: /note="C-term Amide"

SEQ ID NO: 1553 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 2-MeOh-Phe
  MOD_RES (7)..(7): Nle
  source: /note="C-term Amide"

SEQ ID NO: 1554 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 4-Clh-Phe
  MOD_RES (7)..(7): Nle
  MOD_RES (30)..(30): Cha
  source: /note="C-term Amide"

SEQ ID NO: 1555 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 4-Pheh-Phe
  MOD_RES (7)..(7): Nle
  MOD_RES (30)..(30): Cha
  source: /note="C-term Amide"

SEQ ID NO: 1556 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 4-Meh-Phe
  MOD_RES (7)..(7): Nle
  MOD_RES (30)..(30): Cha
  source: /note="C-term Amide"

SEQ ID NO: 1557 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 4-MeOh-Phe
  MOD_RES (7)..(7): Nle
  MOD_RES (30)..(30): Cha
  source: /note="C-term Amide"

SEQ ID NO: 1558 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 3-Brh-Phe
  MOD_RES (7)..(7): Nle
  MOD_RES (30)..(30): Cha
  source: /note="C-term Amide"

SEQ ID NO: 1559 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 3-Clh-Phe
  MOD_RES (7)..(7): Nle
  MOD_RES (30)..(30): Cha
  source: /note="C-term Amide"

SEQ ID NO: 1560 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 3-Pheh-Phe
  MOD_RES (7)..(7): Nle
  MOD_RES (30)..(30): Cha
  source: /note="C-term Amide"

SEQ ID NO: 1561 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 3-Meh-Phe
  MOD_RES (7)..(7): Nle
  MOD_RES (30)..(30): Cha
  source: /note="C-term Amide"

SEQ ID NO: 1562 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 3-MeOh-Phe
  MOD_RES (7)..(7): Nle
  MOD_RES (30)..(30): Cha
  source: /note="C-term Amide"

SEQ ID NO: 1563 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 2-Brh-Phe
  MOD_RES (7)..(7): Nle
  MOD_RES (30)..(30): Cha
  source: /note="C-term Amide"

SEQ ID NO: 1564 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 2-Clh-Phe
  MOD_RES (7)..(7): Nle
  MOD_RES (30)..(30): Cha
  source: /note="C-term Amide"

SEQ ID NO: 1565 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 2-Pheh-Phe
  MOD_RES (7)..(7): Nle
  MOD_RES (30)..(30): Cha
  source: /note="C-term Amide"

SEQ ID NO: 1566 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 2-Meh-Phe
  MOD_RES (7)..(7): Nle
  MOD_RES (30)..(30): Cha
  source: /note="C-term Amide"

SEQ ID NO: 1567 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 2-MeOh-Phe
  MOD_RES (7)..(7): Nle
  MOD_RES (30)..(30): Cha
  source: /note="C-term Amide"

SEQ ID NO: 1568 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 4-Clh-Phe
  MOD_RES (7)..(7): Nle
  MOD_RES (18)..(18): Pra
  source: /note="C-term Amide"

SEQ ID NO: 1569 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 4-Pheh-Phe
  MOD_RES (7)..(7): Nle
  MOD_RES (18)..(18): Pra
  source: /note="C-term Amide"

SEQ ID NO: 1570 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 4-Meh-Phe
  MOD_RES (7)..(7): Nle
  MOD_RES (18)..(18): Pra
  source: /note="C-term Amide"

SEQ ID NO: 1571 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 4-MeOh-Phe
  MOD_RES (7)..(7): Nle
  MOD_RES (18)..(18): Pra
  source: /note="C-term Amide"

SEQ ID NO: 1572 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 3-Brh-Phe
  MOD_RES (7)..(7): Nle
  MOD_RES (18)..(18): Pra
  source: /note="C-term Amide"

SEQ ID NO: 1573 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 3-Clh-Phe
  MOD_RES (7)..(7): Nle
  MOD_RES (18)..(18): Pra
  source: /note="C-term Amide"

SEQ ID NO: 1574 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 3-Pheh-Phe
  MOD_RES (7)..(7): Nle
  MOD_RES (18)..(18): Pra
  source: /note="C-term Amide"

SEQ ID NO: 1575 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 3-Meh-Phe
  MOD_RES (7)..(7): Nle
  MOD_RES (18)..(18): Pra
  source: /note="C-term Amide"

SEQ ID NO: 1576 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 3-MeOh-Phe
  MOD_RES (7)..(7): Nle
  MOD_RES (18)..(18): Pra
  source: /note="C-term Amide"

SEQ ID NO: 1577 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 2-Brh-Phe
  MOD_RES (7)..(7): Nle
  MOD_RES (18)..(18): Pra
  source: /note="C-term Amide"

SEQ ID NO: 1578 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 2-Clh-Phe
  MOD_RES (7)..(7): Nle
  MOD_RES (18)..(18): Pra
  source: /note="C-term Amide"

SEQ ID NO: 1579 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 2-Pheh-Phe
  MOD_RES (7)..(7): Nle
  MOD_RES (18)..(18): Pra
  source: /note="C-term Amide"

SEQ ID NO: 1580 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 2-Meh-Phe
  MOD_RES (7)..(7): Nle
  MOD_RES (18)..(18): Pra
  source: /note="C-term Amide"

SEQ ID NO: 1581 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 2-MeOh-Phe
  MOD_RES (7)..(7): Nle
  MOD_RES (18)..(18): Pra
  source: /note="C-term Amide"

SEQ ID NO: 1582 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): 4-Clh-Phe
  MOD_RES (7)..(7): Nle
  MOD_RES (18)..(18): Pra
  MOD_RES (30)..(30): Cha
  source: /note="C-term Amide"
AYCQKFLWTCDSKRACCGGLRCKLWCRKEA

SEQ ID NO: 1583 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 4-Pheh-Phe
  MOD_RES (7)..(7): Nle
  MOD_RES (18)..(18): Pra
  MOD_RES (30)..(30): Cha
  source: /note="C-term Amide"

SEQ ID NO: 1584 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 4-Meh-Phe
  MOD_RES (7)..(7): Nle
  MOD_RES (18)..(18): Pra
  MOD_RES (30)..(30): Cha
  source: /note="C-term Amide"

SEQ ID NO: 1585 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 4-MeOh-Phe
  MOD_RES (7)..(7): Nle
  MOD_RES (18)..(18): Pra
  MOD_RES (30)..(30): Cha
  source: /note="C-term Amide"

SEQ ID NO: 1586 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 3-Brh-Phe
  MOD_RES (7)..(7): Nle
  MOD_RES (18)..(18): Pra
  MOD_RES (30)..(30): Cha
  source: /note="C-term Amide"

SEQ ID NO: 1587 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 3-Clh-Phe
  MOD_RES (7)..(7): Nle
  MOD_RES (18)..(18): Pra
  MOD_RES (30)..(30): Cha
  source: /note="C-term Amide"

SEQ ID NO: 1588 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 3-Pheh-Phe
  MOD_RES (7)..(7): Nle
  MOD_RES (18)..(18): Pra
  MOD_RES (30)..(30): Cha
  source: /note="C-term Amide"

SEQ ID NO: 1589 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 3-Meh-Phe
  MOD_RES (7)..(7): Nle
  MOD_RES (18)..(18): Pra
  MOD_RES (30)..(30): Cha
  source: /note="C-term Amide"

SEQ ID NO: 1590 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 3-MeOh-Phe
  MOD_RES (7)..(7): Nle
  MOD_RES (18)..(18): Pra
  MOD_RES (30)..(30): Cha
  source: /note="C-term Amide"

SEQ ID NO: 1591 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 2-Brh-Phe
  MOD_RES (7)..(7): Nle
  MOD_RES (18)..(18): Pra
  MOD_RES (30)..(30): Cha
  source: /note="C-term Amide"

SEQ ID NO: 1592 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 2-Clh-Phe
  MOD_RES (7)..(7): Nle
  MOD_RES (18)..(18): Pra
  MOD_RES (30)..(30): Cha
  source: /note="C-term Amide"

SEQ ID NO: 1593 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 2-Pheh-Phe
  MOD_RES (7)..(7): Nle
  MOD_RES (18)..(18): Pra
  MOD_RES (30)..(30): Cha
  source: /note="C-term Amide"

SEQ ID NO: 1594 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 2-Meh-Phe
  MOD_RES (7)..(7): Nle
  MOD_RES (18)..(18): Pra
  MOD_RES (30)..(30): Cha
  source: /note="C-term Amide"

SEQ ID NO: 1595 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 2-MeOh-Phe
  MOD_RES (7)..(7): Nle
  MOD_RES (18)..(18): Pra
  MOD_RES (30)..(30): Cha
  source: /note="C-term Amide"

SEQ ID NO: 1596 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  source: /note="C-term Amide"
GECQKFLWTCDSKRECCEGLRCKLWCRKEI

SEQ ID NO: 1597 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (30)..(30): Cha
  source: /note="C-term Amide"
GECQKWLWTCDSKRECCEGLRCKLWCRKEA

SEQ ID NO: 1598 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (30)..(30): Cha
  source: /note="C-term Amide"
GECQKFLWTCDSKRECCEGLRCKLWCRKEA

SEQ ID NO: 1599 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (6)..(6): hPhe
  MOD_RES (7)..(7): Nle
  source: /note="C-term Amide"
EGCQKFLWTCDEKRACCEGLRCKLWCRKEI

SEQ ID NO: 1600 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (6)..(6): hPhe
  MOD_RES (7)..(7): Nle
  source: /note="C-term Amide"
EGCQKFLWTCDSKRECCEGLRCKLWCRKEI

SEQ ID NO: 1601 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (6)..(6): hPhe
  MOD_RES (7)..(7): Nle
  MOD_RES (30)..(30): Cha
  source: /note="C-term Amide"
EGCQKFLWTCDEKRACCEGLRCKLWCRKEA

SEQ ID NO: 1602 - protein, 30 aa, Artificial Sequence
  source: /note="Description of Artificial Sequence: Synthetic polypeptide"
  source: /note="N-term Amino group"
  MOD_RES (2)..(2): Pra
  MOD_RES (6)..(6): hPhe
  MOD_RES (7)..(7): Nle
  MOD_RES (30)..(30): Cha
  source: /note="C-term Amide"
EGCQKFLWTCDSKRECCEGLRCKLWCRKEA

SEQ ID NO: 1603 - protein, 30 aa, Artificial Sequence; identical to SEQ ID NO: 843
  source: /note="Description of Artificial Sequence: Synthetic polypeptide"
  source: /note="N-term Amino group"
  MOD_RES (1)..(1): Pra
  MOD_RES (6)..(6): 4-Brh-Phe
  MOD_RES (7)..(7): Nle
  source: /note="C-term Amide"

SEQ ID NO: 1604 - protein, 30 aa, Artificial Sequence; identical to SEQ ID NO: 878
  source: /note="Description of Artificial Sequence: Synthetic polypeptide"
  source: /note="N-term Amino group"
  MOD_RES (1)..(1): Pra
  MOD_RES (6)..(6): 4-Brh-Phe
  MOD_RES (7)..(7): Nle
  MOD_RES (30)..(30): Cha
  source: /note="C-term Amide"

SEQ ID NO: 1605 - protein, 30 aa, Artificial Sequence; identical to SEQ ID NO: 864
  source: /note="Description of Artificial Sequence: Synthetic polypeptide"
  source: /note="N-term Amino group"
  MOD_RES (1)..(1): CyA
  MOD_RES (6)..(6): 4-Brh-Phe
  MOD_RES (7)..(7): Nle
  MOD_RES (18)..(18): Pra
  source: /note="C-term Amide"

SEQ ID NO: 1606 - protein, 30 aa, Artificial Sequence; identical to SEQ ID NO: 1582
  source: /note="Description of Artificial Sequence: Synthetic polypeptide"
  source: /note="N-term Amino group"
  MOD_RES (1)..(1): CyA
  MOD_RES (6)..(6): 4-Brh-Phe
  MOD_RES (7)..(7): Nle
  MOD_RES (18)..(18): Pra
  MOD_RES (30)..(30): Cha
  source: /note="C-term Amide"

SEQ ID NO: 1607 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 4tBu-Phe
  source: /note="C-term Amide"
AYCQKWLWTCDSKRACCGGLRCKLFCRKEI

SEQ ID NO: 1608 - protein, 30 aa, Artificial Sequence; identical to SEQ ID NO: 853
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 4tBu-Phe
  source: /note="C-term Amide"

SEQ ID NO: 1609 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 6-Br-Trp
  source: /note="C-term Amide"

SEQ ID NO: 1610 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 6-Me-Trp
  source: /note="C-term Amide"

SEQ ID NO: 1611 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 7-Br-Trp
  source: /note="C-term Amide"

SEQ ID NO: 1612 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSKRACCEGLRCKLWCRKIF

SEQ ID NO: 1613 - protein, 30 aa, Artificial Sequence; identical to SEQ ID NO: 1612
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (30)..(30): hPhe
  source: /note="C-term Amide"

SEQ ID NO: 1614 - protein, 30 aa, Artificial Sequence; identical to SEQ ID NO: 1612
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (30)..(30): 4-Me-Phe
  source: /note="C-term Amide"

SEQ ID NO: 1615 - protein, 30 aa, Artificial Sequence; identical to SEQ ID NO: 876
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (30)..(30): 4-Me-Phe
  source: /note="C-term Amide"

SEQ ID NO: 1616 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (21)..(21): Cit
  MOD_RES (25)..(25): 5-Br-Trp
  source: /note="C-term Amide"
AYCQKWLWTCDSKRACCGGLXCKLWCRKEI

SEQ ID NO: 1617 - protein, 31 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (21)..(21): Cit
  MOD_RES (25)..(25): 5-Br-Trp
  MOD_RES (27)..(27): Cit
  source: /note="C-term FreeAcid"
AYCQKWLWTCDSKRACCGGLXCKLWCXKEIG

SEQ ID NO: 1618 - protein, 31 aa, Artificial Sequence
  source: /note="Description of Artificial Sequence: Synthetic polypeptide"
  source: /note="N-term Amino group"
  MOD_RES (7)..(7): Nle
  MOD_RES (18)..(18): Pra
  MOD_RES (27)..(27): Cit
  source: /note="C-term FreeAcid"
EYCQKWLWTCDSKRACCGGLRCKLWCXKEIG

SEQ ID NO: 1619 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (19)..(19): Pra
  MOD_RES (26)..(26): 5-Br-Trp
  source: /note="C-term Amide"
EVYCQKWLWTCDSKRACCGGLRCKLWCRKEI

SEQ ID NO: 1620 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (13)..(13): Pra
  source: /note="C-term Amide"
EVYCQKWLWTCDGKRACCEGLRCKLWCRKEI

SEQ ID NO: 1621 - protein, 31 aa, Artificial Sequence; identical to SEQ ID NO: 1620
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (13)..(13): Pra
  MOD_RES (26)..(26): 5-Br-Trp
  source: /note="C-term Amide"

SEQ ID NO: 1622 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (13)..(13): Pra
  MOD_RES (26)..(26): 5-Br-Trp
  source: /note="C-term Amide"
EVYCQKWLWTCDGKRACCEGLRCKLWCRKEW

SEQ ID NO: 1623 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (8)..(8): Nle
  MOD_RES (13)..(13): Pra
  MOD_RES (26)..(26): 5-Br-Trp
  MOD_RES (31)..(31): 4tBu-Phe
  source: /note="C-term Amide"
EVYCQKWLWTCDGKRACCEGLRCKLWCRKEF

SEQ ID NO: 1624 - protein, 30 aa, Artificial Sequence; identical to SEQ ID NO: 520
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  MOD_RES (25)..(25): 5-Br-Trp
  source: /note="C-term Amide"

SEQ ID NO: 1625 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  MOD_RES (25)..(25): 4tBu-Phe
  source: /note="C-term Amide"
AYCQKWLWTCDGKRACCEGLRCKLFCRKEI

SEQ ID NO: 1626 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  MOD_RES (25)..(25): 5-Br-Trp
  source: /note="C-term Amide"
AYCQKWLWTCDGERACCEGLRCKLWCRKII

SEQ ID NO: 1627 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (12)..(12): Pra
  source: /note="C-term Amide"
VYCQKWLWTCDGKRACCEGLRCKLWCRKEI

SEQ ID NO: 1628 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (7)..(7): Nle
  MOD_RES (12)..(12): Pra
  source: /note="C-term Amide"
VYCQKWLWTCDGERACCEGLRCKLWCRKEI

SEQ ID NO: 1629 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  MOD_RES (25)..(25): 5-Br-Trp
  source: /note="C-term Amide"
AYCQKWLWTCDGERACCEGLRCKLWCRKEI

SEQ ID NO: 1630 - protein, 31 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"
AYCQKWLWTCDSKRACCGGLRCKLWCRKEIG

SEQ ID NO: 1631 - protein, 32 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term FreeAcid"
AYCQKWLWTCDSKRACCGGLRCKLWCRKEIGE

SEQ ID NO: 1632 - protein, 30 aa, Artificial Sequence; identical to SEQ ID NO: 1616
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (21)..(21): Cit
  source: /note="C-term Amide"

SEQ ID NO: 1633 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (21)..(21): Cit
  MOD_RES (27)..(27): Cit
  source: /note="C-term Amide"
AYCQKWLWTCDSKRACCGGLXCKLWCXKEI

SEQ ID NO: 1634 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  MOD_RES (27)..(27): Cit
  source: /note="C-term Amide"
AYCQKWLWTCDSKRACCGGLRCKLWCXKEI

SEQ ID NO: 1635 - protein, 32 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Br-Trp
  source: /note="C-term FreeAcid"
GYCQKWLWTCDSKRACCEGLRCKLWCRKEFGE

SEQ ID NO: 1636 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
VYCQKFLWTCDEKRACCGGLRCKLWCRKEI

SEQ ID NO: 1637 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
VYCQKFLWTCDSKRACCGGLRCKLWCRKEI

SEQ ID NO: 1638 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (12)..(12): Pra
  MOD_RES (25)..(25): 5-Br-Trp
  source: /note="C-term Amide"
VYCQKFLWTCDGKRACCEGLRCKLWCRKEI

SEQ ID NO: 1639 - protein, 30 aa, Artificial Sequence; identical to SEQ ID NO: 1638
  source: /note="Description of Artificial Sequence: Synthetic polypeptide"
  source: /note="N-term Amino group"
  MOD_RES (1)..(1): Nva
  MOD_RES (6)..(6): 4-Cl-Phe
  MOD_RES (7)..(7): Nle
  MOD_RES (12)..(12): Pra
  MOD_RES (25)..(25): 5-Br-Trp
  source: /note="C-term Amide"

SEQ ID NO: 1640 - protein, 30 aa, Artificial Sequence; identical to SEQ ID NO: 1638
  source: /note="Description of Artificial Sequence: Synthetic polypeptide"
  source: /note="N-term Amino group"
  MOD_RES (1)..(1): Nva
  MOD_RES (6)..(6): 4-Cl-Phe
  MOD_RES (7)..(7): Nle
  MOD_RES (12)..(12): Pra
  source: /note="C-term Amide"

SEQ ID NO: 1641 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (18)..(18): Pra
  source: /note="C-term Amide"
AYCQKFLWTCDSKRACCGGLRCKLWCREEI

SEQ ID NO: 1642 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term Amide"
GYCQKWLWTCDSERACCEGLRCKLWCRQII

SEQ ID NO: 1643 - protein, 30 aa, Artificial Sequence
  source: /note="Description of Artificial Sequence: Synthetic polypeptide"
  source: /note="N-term Amino group"
  MOD_RES (2)..(2): Nva
  MOD_RES (7)..(7): Nle
  MOD_RES (12)..(12): Pra
  MOD_RES (25)..(25): 5-Br-Trp
  source: /note="C-term Amide"
EVCQKWLWTCDGKRACCEGLRCKLWCREEI

SEQ ID NO: 1644 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  source: /note="C-term FreeAcid"
GYCQKWLWTCDSKRACCEGLRCKLWCRKEFG

SEQ ID NO: 1645 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (18)..(18): Pra
  source: /note="C-term Amide"
VYCQKFLWTCDSKRECCGGLRCKLWCRKEI

SEQ ID NO: 1646 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (7)..(7): Nle
  MOD_RES (18)..(18): Pra
  source: /note="C-term FreeAcid"
EVCQKWLWTCDSKRACCGGLRCKLWCREIIG

SEQ ID NO: 1647 - protein, 31 aa, Artificial Sequence
  source: /note="Description of Artificial Sequence: Synthetic polypeptide"
  source: /note="N-term Amino group"
  MOD_RES (2)..(2): Nva
  MOD_RES (7)..(7): Nle
  MOD_RES (18)..(18): Pra
  source: /note="C-term FreeAcid"
EVCQKWLWTCDSKRACCGGLRCKLWCRQEIG

SEQ ID NO: 1648 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTCDSERACCGGLRCKLWCRQII

SEQ ID NO: 1649 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (25)..(25): 5-Br-Trp
  source: /note="C-term Amide"
GYCQKFLWTCDSKRACCEGLRCKLWCRKEF

SEQ ID NO: 1650 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (6)..(6): hPhe
  MOD_RES (7)..(7): Nle
  MOD_RES (12)..(12): Pra
  MOD_RES (25)..(25): 5-Br-Trp
  source: /note="C-term Amide"
AYCQKFLWTCDGKRACCEGLRCKLWCRKEF

SEQ ID NO: 1651 - protein, 30 aa, Artificial Sequence
  source: /note="Description of Artificial Sequence: Synthetic polypeptide"
  source: /note="N-term Amino group"
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
EYCQKFLWTCDSKRACCGGLRCKLWCRKEF

SEQ ID NO: 1652 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (24)..(24): Chg
  MOD_RES (25)..(25): 5-Br-Trp
  source: /note="C-term Amide"
AYCQKWLWTCDSKRACCGGLRCKGWCRKEI

SEQ ID NO: 1653 - protein, 30 aa, Artificial Sequence
  source: /note="Description of Artificial Sequence: Synthetic polypeptide"
  source: /note="N-term Amino group"
  MOD_RES (6)..(6): hPhe
  MOD_RES (7)..(7): Nle
  MOD_RES (12)..(12): Pra
  MOD_RES (24)..(24): Chg
  source: /note="C-term Amide"
EYCQKFLWTCDGKRACCEGLRCKGWCRKEF

SEQ ID NO: 1654 - protein, 31 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (24)..(24): Chg
  source: /note="C-term FreeAcid"
GYCQKWLWTCDEKRACCEGLRCKGWCRKEFG

SEQ ID NO: 1655 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (21)..(21): Cit
  MOD_RES (24)..(24): Chg
  source: /note="C-term Amide"
GYCQKWLWTCDSKRACCEGLXCKGWCRKEI

SEQ ID NO: 1656 - protein, 30 aa, Artificial Sequence
  source: /note="Description of Artificial Sequence: Synthetic polypeptide"
  source: /note="N-term Amino group"
  MOD_RES (7)..(7): Nle
  MOD_RES (18)..(18): Pra
  MOD_RES (21)..(21): Cit
  MOD_RES (24)..(24): Chg
  source: /note="C-term Amide"
EYCQKWLWTCDSKRACCGGLXCKGWCRKEI

SEQ ID NO: 1657 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (12)..(12): Pra
  MOD_RES (24)..(24): Chg
  MOD_RES (25)..(25): 5-Br-Trp
  source: /note="C-term Amide"
AECQKWLWTCDGKRACCEGLRCKGWCRKEI

SEQ ID NO: 1658 - protein, 30 aa, Artificial Sequence; identical to SEQ ID NO: 768
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Br-Trp
  source: /note="C-term Amide"

SEQ ID NO: 1659 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (18)..(18): Pra
  MOD_RES (21)..(21): Cit
  MOD_RES (24)..(24): Chg
  MOD_RES (25)..(25): 5-Br-Trp
  source: /note="C-term Amide"
VYCQKFLWTCDEKRACCGGLXCKGWCRKEF

SEQ ID NO: 1660 - protein, 30 aa, Artificial Sequence
  source: /note="Description of Artificial Sequence: Synthetic polypeptide"
  source: /note="N-term Amino group"
  MOD_RES (1)..(1): Pra
  MOD_RES (6)..(6): hPhe
  MOD_RES (7)..(7): Nle
  MOD_RES (21)..(21): Cit
  MOD_RES (24)..(24): Chg
  MOD_RES (25)..(25): 5-Br-Trp
  source: /note="C-term Amide"
GYCQKFLWTCDEKRACCEGLXCKGWCRKEF

SEQ ID NO: 1661 - protein, 30 aa, Artificial Sequence
  source: /note="Description of Artificial Sequence: Synthetic polypeptide"
  source: /note="N-term Amino group"
  MOD_RES (1)..(1): Nva
  MOD_RES (6)..(6): hPhe
  MOD_RES (7)..(7): Nle
  MOD_RES (18)..(18): Pra
  MOD_RES (25)..(25): 5-Br-Trp
  source: /note="C-term Amide"
VYCQKFLWTCDSKRECCGGLRCKLWCRKIF

SEQ ID NO: 1662 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Me-Trp
  source: /note="C-term Amide"

SEQ ID NO: 1663 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Me-Trp
  source: /note="C-term Amide"

SEQ ID NO: 1664 - protein, 29 aa, Artificial Sequence
  source: /note="Description of Artificial Sequence: Synthetic peptide"
  source: /note="N-term Amino group"
  MOD_RES (6)..(6): Nle
  MOD_RES (11)..(11): Pra
  MOD_RES (24)..(24): 5-Me-Trp
  source: /note="C-term Amide"
YCQKWLWTCDGKRACCEGLRCKLWCRKEI

SEQ ID NO: 1665 - protein, 30 aa, Artificial Sequence; identical to SEQ ID NO: 1607
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): DiCl-Phe
  source: /note="C-term Amide"

SEQ ID NO: 1666 - protein, 30 aa, Artificial Sequence; identical to SEQ ID NO: 853
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): DiCl-Phe
  source: /note="C-term Amide"

SEQ ID NO: 1667 - protein, 30 aa, Artificial Sequence
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  source: /note="C-term Amide"
AYCQKWLWTADSKRACCGGLRAKLWCRKEI

SEQ ID NO: 1668 - protein, 30 aa, Artificial Sequence; identical to SEQ ID NO: 328
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): 5-Cl-Trp
  source: /note="C-term Amide"

SEQ ID NO: 1669 - protein, 30 aa, Artificial Sequence; identical to SEQ ID NO: 853
  source: /note="Description of Artificial Sequence: Synthetic polypeptide"
  source: /note="N-term Amino group"
  MOD_RES (1)..(1): Pra
  MOD_RES (7)..(7): Nle
  MOD_RES (25)..(25): pI-Phe
  source: /note="C-term Amide"

SEQ ID NO: 1670 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): 5-Cl-Trp
  source: /note="C-term Amide"

SEQ ID NO: 1671 - protein, 30 aa, Artificial Sequence; identical to SEQ ID NO: 1607
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra
  MOD_RES (25)..(25): pI-Phe
  source: /note="C-term Amide"

SEQ ID NO: 1672 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDEKRACCGGLRCKLWCRKEI

SEQ ID NO: 1673 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDEERACCGGLRCKLWCRKEI

SEQ ID NO: 1674 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDEERACCGGLVCKLWCRKEI

SEQ ID NO: 1675 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSARACCGGLRCKLWCRKEI

SEQ ID NO: 1676 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSKRACCGDLRCKLWCRKEI

SEQ ID NO: 1677 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSERACCGDLRCKLWCRKEI

SEQ ID NO: 1678 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSERACCGDLVCKLWCRKEI

SEQ ID NO: 1679 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSKRACCGGLVCKLWCRKEI

SEQ ID NO: 1680 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSKRACCGGLRCQLWCRKEI

SEQ ID NO: 1681 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSKRACCGGLRCKLWCRYEI

SEQ ID NO: 1682 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDSKRACCGGLRCKLWCRLEI

SEQ ID NO: 1683 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDEERACCEGLVCKLWCRKEI

SEQ ID NO: 1684 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSARACCEGLRCKLWCRKEI

SEQ ID NO: 1685 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEDLRCKLWCRKEI

SEQ ID NO: 1686 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSERACCEDLRCKLWCRKEI

SEQ ID NO: 1687 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSERACCEDLVCKLWCRKEI

SEQ ID NO: 1688 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLVCKLWCRKEI

SEQ ID NO: 1689 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLRCKLWCRYEI

SEQ ID NO: 1690 - protein, 29 aa, Artificial Sequence
  source: /note="Description of Artificial Sequence: Synthetic peptide"
  source: /note="N-term Amino group"
  MOD_RES (1)..(1): Pra
  MOD_RES (6)..(6): Nle
  source: /note="C-term Amide"
GCQKWLWTCDSKRACCEGLRCKLWCRLEI

SEQ ID NO: 1691 - protein, 29 aa, Artificial Sequence
  source: /note="Description of Artificial Sequence: Synthetic peptide"
  source: /note="N-term Amino group"
  MOD_RES (1)..(1): CyA
  MOD_RES (6)..(6): Nle
  MOD_RES (17)..(17): Pra
  source: /note="C-term Amide"
ACQKWLWTCDEERACCGGLVCKLWCRKII

SEQ ID NO: 1692 - protein, 30 aa, Artificial Sequence; identical to SEQ ID NO: 395
  source: /note="Description of Artificial Sequence: Synthetic polypeptide"
  source: /note="N-term Amino group"
  MOD_RES (1)..(1): CyA
  MOD_RES (7)..(7): Nle
  MOD_RES (18)..(18): Pra modified with a unique side chain
  source: /note="C-term Amide"
  source: /note="see specification as filed for detailed description of substitutions and preferred embodiments"

SEQ ID NO: 1693 - protein, 30 aa, Artificial Sequence; identical to SEQ ID NO: 338
  source: /note="Description of Artificial Sequence: Synthetic polypeptide"
  source: /note="N-term Amino group"
  MOD_RES (1)..(1): Atz
  MOD_RES (7)..(7): Nle
  MOD_RES (25)..(25): 5-Br-Trp
  source: /note="C-term Amide"

SEQ ID NO: 1694 - protein, 30 aa, Artificial Sequence
  source: /note="Description of Artificial Sequence: Synthetic polypeptide"
  source: /note="N-term Amino group"
  MOD_RES (2)..(2): Atz
  MOD_RES (7)..(7): Nle
  source: /note="C-term Amide"
EACQKWLWTCDSKRECCEGLRCKLWCRKEI

SEQ ID NO: 1695 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTCFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1696 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTDFTLTISRLEPEDFAVYYCQQFGSSPWTFGQGTKVEIKRTCAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1697 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTDFTLTISRLEPEDFAVYYCQQFGSSPWTFGQGTKVEIKRTVACPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1698 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1699 - protein, 215 aa, Artificial Sequence; identical to SEQ ID NO: 1698
  source: /note="Description of Artificial Sequence: Synthetic polypeptide"

SEQ ID NO: 1700 - protein, 215 aa, Artificial Sequence; identical to SEQ ID NO: 1698
  source: /note="Description of Artificial Sequence: Synthetic polypeptide"

SEQ ID NO: 1701 - protein, 215 aa, Artificial Sequence; identical to SEQ ID NO: 1698
  source: /note="Description of Artificial Sequence: Synthetic polypeptide"

SEQ ID NO: 1702 - protein, 215 aa, Artificial Sequence; identical to SEQ ID NO: 1698
  source: /note="Description of Artificial Sequence: Synthetic polypeptide"

SEQ ID NO: 1703 - protein, 215 aa, Artificial Sequence; identical to SEQ ID NO: 1698
  source: /note="Description of Artificial Sequence: Synthetic polypeptide"

SEQ ID NO: 1704 - protein, 215 aa, Artificial Sequence; identical to SEQ ID NO: 1698
  source: /note="Description of Artificial Sequence: Synthetic polypeptide"

SEQ ID NO: 1705 - protein, 215 aa, Artificial Sequence; identical to SEQ ID NO: 1698
  source: /note="Description of Artificial Sequence: Synthetic polypeptide"

SEQ ID NO: 1706 - protein, 215 aa, Artificial Sequence; identical to SEQ ID NO: 1698
  source: /note="Description of Artificial Sequence: Synthetic polypeptide"

SEQ ID NO: 1707 - protein, 215 aa, Artificial Sequence; identical to SEQ ID NO: 1698
  source: /note="Description of Artificial Sequence: Synthetic polypeptide"

SEQ ID NO: 1708 - protein, 215 aa, Artificial Sequence; identical to SEQ ID NO: 1698
  source: /note="Description of Artificial Sequence: Synthetic polypeptide"

SEQ ID NO: 1709 - protein, 215 aa, Artificial Sequence; identical to SEQ ID NO: 1698
  source: /note="Description of Artificial Sequence: Synthetic polypeptide"

SEQ ID NO: 1710 - protein, 215 aa, Artificial Sequence; identical to SEQ ID NO: 1698
  source: /note="Description of Artificial Sequence: Synthetic polypeptide"

SEQ ID NO: 1711 - protein, 215 aa, Artificial Sequence; identical to SEQ ID NO: 1698
  source: /note="Description of Artificial Sequence: Synthetic polypeptide"

SEQ ID NO: 1712 - protein, 215 aa, Artificial Sequence; identical to SEQ ID NO: 1698
  source: /note="Description of Artificial Sequence: Synthetic polypeptide"

SEQ ID NO: 1713 - protein, 215 aa, Artificial Sequence; identical to SEQ ID NO: 1698
  source: /note="Description of Artificial Sequence: Synthetic polypeptide"

SEQ ID NO: 1714 - protein, 215 aa, Artificial Sequence; identical to SEQ ID NO: 1698
  source: /note="Description of Artificial Sequence: Synthetic polypeptide"

SEQ ID NO: 1715 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1716 - protein, 452 aa, Artificial Sequence; identical to SEQ ID NO: 1715
  source: /note="Description of Artificial Sequence: Synthetic polypeptide"

SEQ ID NO: 1717 - protein, 452 aa, Artificial Sequence; identical to SEQ ID NO: 1715
  source: /note="Description of Artificial Sequence: Synthetic polypeptide"

SEQ ID NO: 1718 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTACDTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1719 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1720 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPCVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1721 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPCPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1722 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVCVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1723 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPCVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1724 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTCRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1725 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPRCPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1726 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREECTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1727 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMCKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1728 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKCQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1729 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNCVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1730 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPCNNYKTTPPVLDSDGSFFLYSKLTVDKSRWQQGNVFSCSVMHEALHNHYTQKSLSLSPGK

SEQ ID NO: 1731 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENCYKTTPPVLDSDGSFFLYSKLTVDKSRWQQGNVFSCSVMHEALHNHYTQKSLSLSPGK

SEQ ID NO: 1732 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVCKSRWQQGNVFSCSVMHEALHNHYTQKSLSLSPGK

SEQ ID NO: 1733 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKCRWQQGNVFSCSVMHEALHNHYTQKSLSLSPGK

SEQ ID NO: 1734 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLCLSPGK

SEQ ID NO: 1735 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPRCPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1736 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKCQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1737 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNCVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1738 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENCYKTTPPVLDSDGSFFLYSKLTVDKSRWQQGNVFSCSVMHEALHNHYTQKSLSLSPGK

SEQ ID NO: 1739 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVCDSDGSFFLYSKLTVDKSRWQQGNVFSCSVMHEALHNHYTQKSLSLSPGK

SEQ ID NO: 1740 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVCKSRWQQGNVFSCSVMHEALHNHYTQKSLSLSPGK

SEQ ID NO: 1741 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMCKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1742 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1743 - protein, 452 aa, Artificial Sequence
  source: /note="Description of Artificial Sequence: Synthetic polypeptide"
QVQLQESGPGLVKPSQTLSLTCTVSGGSISSGDYFWSWIRQLPGKGLEWIGHIHNSGTTYYNPSLKSRVTISVDTSKKQFSLRLSSVTACDTAVYYCARDRGGDYAYGMDVWGQGTTVTVSSAVSWNSGALTSGVHTFPAVLQSSGLYSLSSVVTVPSSSLGTQTYICNVNHKPSNTKVDKRVEPKSCDKTHTCPPCPAPELLSTKGPSVFPLAPSSKSTSGGTAALGCLVKDYFPEPVTGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1744 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSQESVTEQDSKDSTYSLSSTLTLSKADYEKHKVYACEVTHQGLSSPVTKSFNRGECGTASVVCLLNNFYPREAKVQWKVDNALQSGNS

SEQ ID NO: 1745 - protein, 16 aa, Artificial Sequence
  source: /note="Description of Artificial Sequence: Synthetic peptide"
KKYTYEINGKKITVEI

SEQ ID NO: 1746 - protein, 10 aa, Artificial Sequence
  source: /note="Description of Artificial Sequence: Synthetic peptide"
CHWEGNKLVC

SEQ ID NO: 1747 - protein, 34 aa, Artificial Sequence
  Synthetic polypeptide
  MISC_FEATURE (1)..(1): absent
  MISC_FEATURE (2)..(2): absent or any amino acid residue
  MISC_FEATURE (3)..(3): any amino acid residue
  MISC_FEATURE (8)..(8): Nle, Nva, Leu, Ile, Val, or Phe residue
  MISC_FEATURE (14)..(14): Ala, Glu, or Asp residue
  MISC_FEATURE (15)..(15): Arg or Cit residue
  MISC_FEATURE (16)..(16): Ala, Glu or Asp residue
  MISC_FEATURE (19)..(19): any amino acid residue
  MISC_FEATURE (26)..(26): Trp or 5-bromoTrp residue
  MISC_FEATURE (30)..(30): Glu or Asp residue
  MISC_FEATURE (31)..(31): Ile, Trp, Phe, hPhe, Cha, 1-Nal, or 2-Nal residue
  MISC_FEATURE (32)..(34): independently absent or is independently a hydrophobic or acidic amino acid residue, or a Ser or Gly residue
XXXCQKWXWTCDSXXXCCXGLRCKLXCRKXXXXX

---

What is claimed:

1. A composition of matter comprising an isolated polypeptide comprising the amino acid sequence of the formula:

$X_{aa}{}^{1}X_{aa}{}^{2}X_{aa}{}^{3}Cys^{4}Gln^{5}Lys^{6}Trp^{7}X_{aa}{}^{8}Trp^{9}Thr^{10}$
$Cys^{11}Asp^{12}Ser^{13}X_{aa}{}^{14}X_{aa}{}^{15}X_{aa}{}^{16}Cys^{17}$
$Cys^{18}X_{aa}{}^{19}Gly^{20}Leu^{21}Arg^{22}Cys^{23}Lys^{24}$
$Leu^{25}X_{aa}{}^{26}Cys^{27}Arg^{28}LyS^{29}X_{aa}{}^{30}X_{aa}{}^{31}$
$X_{aa}{}^{32}X_{aa}{}^{33}X_{aa}{}^{34}$ (SEQ ID NO:1747)

or a pharmaceutically acceptable salt thereof,
wherein:

$X_{aa}{}^{1}$ is absent and $X_{aa}{}^{2}$ is any amino acid residue; or $X_{aa}{}^{1}$ is absent and $X_{aa}{}^{2}$ is absent;
$X_{aa}{}^{3}$ is any amino acid residue;
$X_{aa}{}^{8}$ is a norleucine (Nle), norvaline (Nva), Leu, Ile, Val, or Phe residue;
$X_{aa}{}^{14}$ is an Ala, Glu, or Asp residue;
$X_{aa}{}^{15}$ is an Arg or Cit residue;
$X_{aa}{}^{16}$ is an Ala, Glu, or Asp residue;
$X_{aa}{}^{19}$ is any amino acid residue;
$X_{aa}{}^{26}$ is a Trp or 5-bromoTrp residue;
$X_{aa}{}^{30}$ is a Glu or Asp residue;
$X_{aa}{}^{31}$ is an Ile, Trp, Phe, hPhe, cyclohexylalanine (Cha), 1-Nal, or 2-Nal residue;
each of $X_{aa}{}^{32}$, $X_{aa}{}^{33}$, and $X_{aa}{}^{34}$ is independently absent or is independently a hydrophobic or acidic amino acid residue, or a Ser or Gly residue;
and wherein:
there is a disulfide bond between $Cys^{4}$ and $Cys^{18}$;
there is a disulfide bond between $Cys^{11}$ and $Cys^{23}$;
there is a disulfide bond between $Cys^{17}$ and $Cys^{27}$;
the amino-terminal residue is optionally acetylated, biotinylated, or 4-pentynoylated, or PEGylated; and
the carboxy-terminal residue is optionally amidated.

2. The composition of matter of claim 1, wherein $X_{aa}{}^{2}$ is a Pra, hPra, bhPra, EPA, Aha, (S)-2-amino-4-hexynoic acid, Abu, Nva, Nle, Sar, hLeu, hPhe, D-Leu, D-Phe, D-Ala, bAla, AllylG, CyA, Atz, Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, or 4-phenyl-phenylalanine (Bip) residue.

3. The composition of matter of claim 1, wherein $X_{aa}{}^{2}$ is an acidic amino acid residue.

4. The composition of matter of claim 1, wherein $X_{aa}{}^{8}$ is a Nle or Leu residue.

5. The composition of matter of claim 1, wherein $X_{aa}{}^{14}$ is Glu, $X_{aa}{}^{16}$ is Glu, or both $X_{aa}{}^{14}$ and $X_{aa}{}^{16}$ are Glu residues.

6. The composition of matter of claim 1, wherein $X_{aa}{}^{15}$ is a Cit residue.

7. The composition of matter of claim 1, wherein $X_{aa}{}^{26}$ is a 5-bromoTrp residue.

8. The composition of matter of claim 1, wherein $X_{aa}{}^{30}$ is a Glu residue.

9. The composition of matter of claim 1, wherein $X_{aa}{}^{31}$ is an Ile, Trp, Cha, Phe, or hPhe residue.

10. The composition of matter of claim 1, wherein $X_{aa}{}^{14}$ and $X_{aa}{}^{30}$ are each Glu residues.

11. The composition of matter of claim 1, wherein $X_{aa}{}^{16}$ and $X_{aa}{}^{30}$ are each Glu residues.

12. The composition of matter of claim 1, wherein $X_{aa}{}^{14}$ and $X_{aa}{}^{30}$ are each Glu residues, and $X_{aa}{}^{26}$ is a 5-bromoTrp residue.

13. The composition of matter of claim 1, wherein $X_{aa}{}^{16}$ and $X_{aa}{}^{30}$ are each Glu residues, and $X_{aa}{}^{26}$ is a 5-bromoTrp residue.

14. The composition of matter of claim 1, wherein the carboxy-terminal residue is amidated.

15. The composition of matter of claim 1, further comprising a half-life extending moiety, wherein the half-life extending moiety is covalently linked, optionally through a linker moiety, to the polypeptide.

16. The composition of matter of claim 15, wherein the half-life extending moiety is covalently linked to the polypeptide at:

(a) the N-terminal residue;

(b) the C-terminal residue; or (c) $X_{aa}^{2}$, $X_{aa}^{3}$, or $X_{aa}^{19}$.

17. The composition of matter of claim 15, wherein the linker moiety is a multivalent linker.

18. The composition of matter of claim 15, wherein the half-life extending moiety is polyethylene glycol of molecular weight of about 1000 Da to about 100000 Da, an IgG Fc domain, a transthyretin, a human serum albumin, or a lipid.

19. The composition of matter of claim 15, wherein the half-life extending moiety comprises a human immunoglobulin or a human immunoglobulin Fc domain, or both.

20. The composition of matter of claim 19, wherein the composition comprises the polypeptide covalently linked to an immunoglobulin or immunoglobulin Fc domain to form a monovalent immunoglobulin-peptide or Fc-peptide conjugate.

21. The composition of matter of claim 19, wherein the composition comprises two copies of the polypeptide covalently linked to an immunoglobulin or immunoglobulin Fc domain to form a bivalent immunoglobulin-peptide or Fc-peptide conjugate.

22. The composition of matter of claim 18, wherein the composition comprises the polypeptide covalently linked to human serum albumin to form a human-serum albumin-peptide conjugate.

23. The composition of matter of claim 18, wherein the composition comprises the polypeptide covalently linked to a lipid.

24. A composition of matter comprising an isolated polypeptide comprising the amino acid sequence of SEQ ID NO: 715.

25. A pharmaceutical composition, comprising the composition of matter of claim 1, and a pharmaceutically acceptable carrier.

* * * * *